US008119365B2

(12) United States Patent
Blattner et al.

(10) Patent No.: US 8,119,365 B2

(45) **Date of Patent: *Feb. 21, 2012**

(54) INSERTION SEQUENCE-FREE BACTERIA

(75) Inventors: Frederick R. Blattner, Madison, WI (US); John W. Campbell, Oak Park, IL (US); David Frisch, Fitchburg, WI (US); Guy Plunkett, Madison, WI (US); Gyorgy Posfai, Szeged (HN)

(73) Assignee: Wisconsin Alumni Research Foundation, Madison, WI (US)

( * ) Notice: Subject to any disclaimer, the term of this patent is extended or adjusted under 35 U.S.C. 154(b) by 1546 days.

This patent is subject to a terminal disclaimer.

(21) Appl. No.: 11/400,711

(22) Filed: Apr. 7, 2006

(65) Prior Publication Data

US 2007/0054358 A1 Mar. 8, 2007

Related U.S. Application Data

(63) Continuation-in-part of application No. 11/275,094, filed on Dec. 9, 2005, and a continuation-in-part of application No. 10/896,739, filed on Jul. 22, 2004, now abandoned, which is a continuation of application No. PCT/US03/01800, filed on Jan. 22, 2003, which is a continuation-in-part of application No. 10/057,582, filed on Jan. 23, 2002, now Pat. No. 6,989,265.

(60) Provisional application No. 60/634,611, filed on Dec. 9, 2004, provisional application No. 60/409,089, filed on Sep. 6, 2002.

(51) Int. Cl.
*C12N 15/09* (2006.01)
*C12N 15/10* (2006.01)
*C12N 1/20* (2006.01)

(52) U.S. Cl. .................... 435/69.1; 435/91.1; 435/252.8

(58) Field of Classification Search ........................ None
See application file for complete search history.

(56) References Cited

U.S. PATENT DOCUMENTS

| | | | | |
|---|---|---|---|---|
| 4,851,348 | A | 7/1989 | Hanahan | 435/6 |
| 4,981,797 | A | 1/1991 | Jessee et al. | 435/252.8 |
| 5,578,464 | A | 11/1996 | Lunn et al. | 435/69.1 |
| 5,747,662 | A | 5/1998 | Simmons et al. | 536/24.1 |
| 5,824,502 | A | 10/1998 | Honjo et al. | 435/69.1 |
| 5,962,327 | A | 10/1999 | Dujon et al. | 435/478 |
| 6,015,709 | A | 1/2000 | Natesan | 435/366 |
| 6,022,952 | A | 2/2000 | Weiner et al. | 530/350 |
| 6,117,680 | A | 9/2000 | Natesan et al. | 435/455 |
| 6,238,924 | B1 | 5/2001 | Dujon et al. | 435/477 |
| 6,335,178 | B1 | 1/2002 | Weiner et al. | 435/69.1 |
| 6,372,476 | B1 | 4/2002 | Belguith et al. | 435/233 |
| 6,410,273 | B1 | 6/2002 | Crouzet et al. | 435/91.1 |
| 6,509,156 | B1 | 1/2003 | Stewart et al. | 435/6 |
| 6,989,265 | B2 | 1/2006 | Blattner et al. | 435/252.8 |
| 2003/0138937 | A1 | 7/2003 | Blattner et al. | 435/252.33 |
| 2005/0032225 | A1 | 2/2005 | Blattner et al. | 435/488 |

FOREIGN PATENT DOCUMENTS

| | | |
|---|---|---|
| EP | 0177343 | 4/1986 |
| EP | 0283726 | 9/1988 |
| WO | WO 88/05821 | 8/1988 |
| WO | WO 96/14408 | 5/1996 |
| WO | WO 01/27258 | 4/2001 |
| WO | WO 02/14495 | 2/2002 |
| WO | WO 03/048374 | 6/2003 |
| WO | WO 03/070880 | 8/2003 |
| WO | WO 2005/087940 | 9/2005 |

OTHER PUBLICATIONS

Khosla et al., "Expression of Recombinant Proteins in *Escherichia coli* Using an Oxygen-Responsive Promoter," *Bio/Technology*, 8:554-558, 1990.

Passoth et al., "Analysis of the hypoxia-induced ADH2 promoter of the respiratory yeast Pichia stipitis reveals a new mechanism for sensing of oxygen limitation in yeast," *Yeast*, 20:39-51, 2003.

Xu and Tabita, "Positive and negative regulation of sequences upstream of the form II cbb CO2 fixation operon of Rhodobacter sphaeroides," *J. Bacteriol.*, 176:7299-7308, 1994.

PCT/US2007/066087 International Search Report, mailed Sep. 17, 2007.

Posfai et al., "Emergent properties of reduced-genome *Escherichia coli," Science*, 312:1044-1046, 2002.

Sharma et al., "Recombinant protein production in an *Escherichia coli* reduced genome strain," *Metabolic Engineering*, 9:133-141, 2007.

Aristidou et al., "Modification of central metabolic pathway in *Escherichia coli* to reduce acetate accumulation by heterologous expression of the bacillus subtilis acetolactate synthase gene," *Biotechnology and Bioengineering*, 44:944-951, 1994.

Asai et al., "An *Escherichia coli* strain with all chromosomal rRNA operons inactivated: complete exchange of rRNA genes between bacteria," *Proc. Natl. Acad. Sci., USA*, 96:1971-1976, 1999.

Balbas, "Understanding the art of producing protein and non-protein molecules in *E. coli," Molec Biotechnol.*, 19:251-267, 2001.

Baneyx, "Recombinant protein expression in *E. coli," Curr Opin Biotech*, 10:411-421, 1999.

Bass et al., "Mulitcopy suppressors of Prc mutang *Escherichia coli* include two HtrA (DegP) protease homologs (HhoAB), DksA, and a truncated RlpA,"*Journal of Bacteriology*, 178(4):1154-1161, 1996.

Beaulieu et al , "Pathogenic behavior of pectinase-defective Erwinia chrysanthemi mutants on different plants," *MPMI*, 6(2):197-202, 1993.

Bermejo et al., "Expression of clostridium acetobutylicum ATCC 824 genes in *escherichia coli* for acetone production and acetate detoxification," *Applied and Environmental Microbiology*, 64:1079-1085, 1998.

Berry et al., "Application of metabolic engineering to improve both production and use of biotech indigo," *J Indust Micro & Biotech*, 22:127-133, 2002.

Blattner et al., "The complete genome sequence of *Escherichia coli* K-12," *Science*, 277:1453-1474, 1997.

(Continued)

*Primary Examiner* — Nancy Vogel

(74) *Attorney, Agent, or Firm* — Fulbright & Jaworski

(57) ABSTRACT

A bacteria lacking genomic and non-genomic IS elements is provided. The bacteria may be more stable and useful for the production of amino acids, polypeptides, nucleic acids and other products.

14 Claims, 8 Drawing Sheets

OTHER PUBLICATIONS

Blaudeck et al., "Specificity of single peptide recognition in TAT-dependent bacterial protein translocation," *J. Bacteriology*, 183:604-610, 2001.
Chang et al., "Acetate metabolism in a pta mutant of *Escherichia coli* W3110: Importance of maintaining acetyl coenzyme a flux for growth and survival," *Journal of Bacteriology*, 181:6656-6663, 1999.
Chou et al., "Effect of modified glucose uptake using genetic engineering techniques on high-level recombinant protein production in *Escherichia coli* dense cultures," *Biotechnology and Bioengineering* 44:953-960, 1994.
Contiero et al., "Effects of mutations in acetate metabolism on high-cell-density growth of *Eschrichia coli*," *Journal of Industrial Microbiology & Biotechnology*, 24:421-430, 2000.
Court et al., "Genetic engineering using homologous recombination," *Annu Rev Genet*, 36:361-388, 2002.
Danese et al., "Targeting and assembly of periplasmic and outer-membrane proteins in *Escherichia coli*," *Annu Rev Genet*, 32:59-64, 1998.
Database EMBL, "*E.coli* genomic DNA, Kohaia clone #421(55.1-55.5 min.)," Database Accession No. ECD874, 1999.
Datsenko and Wanner, "One-step inactivation of chromosomal genes in *Escherichia coli* K-12 using PCR products," *Proc. Natl. Acad. Sci. USA*, 97:6640-6645, 2000.
Dedhia et al., "Overproduction of glycogen in *Escherichia coli* blocked in the acetate pathway improved cell growth," *Biotechnology and Bioengineering*, 44:132-139, 1994.
Degryse, "Evaluation of *Escherichia coli* recBC sbcBC mutants for cloning by recombination in vivo," *J. Biotechnology*, 39:181-187, 1995.
DeLisa et al., "Quorum sensing via AI-2 communicates the metabolic burden associated with heterologous protein production in *E. coli*," *Biotech Bioeng*, 75(4):439-450, 2001.
Diaz-Ricci et al., "Effects of alteration of the acetic acid synthesis pathway on the fermentation pattern of *Escherichia coli*," *Biotechnology and Bioengineering*, 38:1318-1324, 1991.
Dykstra and Kushner, "Physical characterization of the cloned protease III gene from *Escherichia coli* K-12," *Journal of Bacteriology*, 163(3):1055-1059, 1985.
Eichhorn et al., "Deletion analysis of the *Escherichia coli* taurine and alkanesulfonate transport systems," *Journal of Bacteriology*, 182(10)2687-2695, 2000.
Farmer and Liao., "Reduction of aerobic acetate production by *Escherichia coli*," *Applied and Environmental Microbiology*, 63:3205-3210, 1997.
Fekkes and Driessen, "Protein targeting to the bacterial cytoplasmic membrane," *Microbiol. Mol. Biol. Rev.*, 63:161-193, 1999.
GenBank Accession No. AE014073, 2006.
GenBank Accession No. AE014075, 2006.
GenBank Accession No. AF348706, 2001.
GenBank Accession No. AP009048, 2006.
GenBank Accession No. U00096, 2006.
Gill et al., "A comparative study of global stress gene regulation in response to overexpression of recombinant proteins in *E. coli*," *Metabolic Engineering*, 2:178-189, 2000.
Hahm et al., "Characterization and evaluation of a pta (phoshotransacetylase) negative mutant of *Escherichia coli* HB101 as production host of foreign lipase," *Applied Microbiology and Biotechnology*, 42:100-107, 1994.
Hall, "Activation of the bgl operon by adaptive mutation," *Mol. Biol. Evol.*, 15:1-5, 1998.
Hanahan, "Studies on transformation of *Escherichia coli* with plasmids," *J. Mol. Biol.*, 166(4):557-580, 1983.
Hannig and Makrides, "Strategies for optimizing heterologous protein expression in *Escherichia coli*," *Trends Biotechnol.*, 16(2):54-60, 1998.
Hayashi et al., "Construction of a genetic linkage map of the model legume Lotus japonicus using an intraspecific F2 population," *DNA Research*, 8:11-22, 2001.
Hengen, "Better competent cells and DNA polymerase contaminants," *Trends in Biochem. Sci.*, 19:426-427, 1994.
Hengen, "Preparing ultra-competent *Escherichia coli*," *Trends in Biochem. Sci.*, 21:75-76, 1996.
Hockney, "Recent developments in heterologous protein production in *Escherichia coli*," *Trends Biotechnol.*, 12(11):456-632, 1994.
Holms, "Flux analysis and control of the central metabolic pathways in *Escherichia coli*," *FEMS Microbiology Reviews*, 19:85-116, 1996.
Holms, "The central metabolic pathways of *Escherichia coli*: relationship between flux and control at a branch point, efficiency of conversion to biomass, and excretion of acetate," *Current Topics in Cellular Regulation*, 28:69-105, 1986.
Hynds et al., "The sec-independent twin-arginine translocation system can transport both tightly folded and malfolded proteins across the thylakoid membrane," *J. Biol. Chem.*, 273:34868-34874, 1998.
Kakuda et al., "Construction of Pta-Ack pathway deletion mutants of *Escherichia coli* and characteristic growth profiles of the mutants in a rich medium," *Bioscience Biotechnology Biochemistry*, 58:2232-2235, 1994.
Kitamura et al., "DNA sequence changes in mutations in the ton B gene on the chromosome of *Escherichia coli* K-12: insertion elements dominate the spontaneous spectra,," *Jpn J. Genet*, 70:35-46, 1995.
Kolisnychenko et al., "Engineering a reduced *Escherichia coli* genome," *Genome Research*, 12:640-647, 2002.
Koob et al., "Minimizing the genome of *Escherichia coli*," *Ann NY Acad Science*, 745:1-3, 1994.
Koonin, "How many genes can make a cell: the minimal-gene-set concept," *Ann Rev Genome Hum Genet*, 1:99-116, 2000.
Lee, "High cell-density culture of *Escherichia coli*," *TIBECH*, 14:98-103, 1996.
Mersereau et al., "Efficient transformation of Agrobacterium tumefaciens by electroporation," *Gene*, 90:149-151, 1990.
Murphy, "Use of bacteriophage λ recombination functions to promote gene replacement in *Escherichia coli*," *J. Bacteriol.*, 180:2063-2071, 1998.
Muyrers et al., "Rapid modification of bacterial artificial chromosomes by ET-recombination," *Nucleic Acids Research*, 27:1555-1557, 1999.
Neidhardt et al., "Culture medium for Enterobacteria," *J. Bacteriol.*, 119:736-747, 1974.
Oliner et al., "In vivo cloning of PCR products in *E. coli*," *Nucleic Acids Research*, 2(22):5192-5197, 1993.
Otto and Silhavy, "Surface sensing and adhesion of *E. coli* controlled by the Cpx-signaling pathway," *Proc. Natl. Acad. Sci., USA*, 99(4):2287-2292, 2002.
Park et al., "MppA, a perplasmic binding protein essential for import of the bacterial cell wall peptide L-Ananyl-γ-D-glutamy-l-meso-diaminopimelate," *Journal of Bacteriology*, 180(5):1215-1223, 1998.
Perna et al, "Genome sequence of enterohemorrhagic *Escherichia coli* O157:H7," *Nature*, 409:529-533, 2001.
Perna et al., "The genomes of *Escherichia coli* K-12 and pathogenic *E. coli*," *Pathogenic E. coli Paradigm for Bacterial Pathogenesis*, M.S. Donnenberg, Editor, Academmic Press, 2002.
Pfeifer et al., "Biosynthesis of complex polyketides in metabolically engineered strain of *E. coli*," *Science* 291:1790-1792, 2001.
Ponce, "Effect of growth rate reduction and genetic modifications of acetate accumulation and biomass yields in *Escherichia coli*," *Biotechnology and Bioengineering*, 87:775-780, 1999.
Pope and Kent, "High efficiency 5 min transformation of *Escherichia coli*," *Nucleic Acids Research*, 24:536-537, 1996.
Posfai et al, "In vivo excision and amplification of large segments of the *Escherichia coli* genome," *Nucleic Acids Research*, 22(12):2392-2398, 1994.
Posfai et al., "Markerless gene replacement in *Escherichia coli* stimulated by a double-strand break in the chromosome," *Nucleic Acids Research*, 27:4409-4415, 1999.
Posfai et al., "Versatile insertion plasmids for targeted genome manipulations in bacteria: isolation, deletion, and rescue of the pathogenicity island LEE of the *Escherichia coli* O157:H7 genome," *J. Bacteriol.*, 179:4426-4428, 1997.
Pugsley, "The complete general secretory pathway in gram-negative bacteria," *Microbiol. Rev.*, 57:50-108, 1993.
Riesenberg, "High cell density cultivation of *E. coli* at controlled specific growth rate," *J. Biotech*, 20(10):17-27, 1991.

Riggs , "Expression and Purification of Maltose-Binding Protein Fusions," *Current Protocols Mol. Biol.*, 16.6.1-16.6.14, John Wiley and Sons, 1994.

Ritz and Beckwith, "Roles of thiol redox pathways in bacteria," *Annu Rev Microbiol*, 55:21-48, 2001.

Santini et al., "A novel sec-independent periplasmic protein translocation pathway in *Escherichia coli,*" *EMBO J.*, 17:101-112, 1998.

Sargent et al, "Overlapping functions of components of a bacterial sec-independent protein export pathway," *EMBO J*, 17:3640-3650, 1998.

Schaechter and Neidhardt., "Introduction," In: *Escherichia coli and Salmonella*, ed. Neidhart, FC et al., 1-2, ASM Press, Washington, D.C., 1997.

Schutz et al., "Sulfide-quinone reductase from Rhodobacter capsulatus: requirement for growth, periplasmic localization, and extension of gene sequence analysis," *Journal of Bacteriology*, 181(20):6516-6523, 1999.

Selinger et al., "RNA expression analysis using a 30 base pair resolution *Escherichia coli* genome array," *Nat Biotechnol*, 18(12):1262-1268, 2000.

Shiloach and Fass, "Growing *E. Coli* to high cell density-A historical perspective on method development," *Biotechnology Advances*, 23:345-357, 2005.

Shiloach et al. "Effect of glucose supply strategy on acetate accumulation, by *Escherichia coli* BL21 (lambda-DE3)and *Escherichia coli* JM109," *Biotechnology and Bioengineering*, 49:421-428, 1996.

Shuman, "Active transport of maltose in *Escherichia coli* K12," *J. Biol. Chem.*, 257(10):5455-5461, 1982.

Simmons and Yansura, "Translational level is a critical factor for secretion of heterologous proteins in *E. coli,*" *Nature*, 14:629-634, 1996.

Singh-Gasson et al., "Maskless fabrication of light-directed oligonucleotide microarrays using a digital micromirror array," *Nat Biotechnol.*, 17(10):974-978, 1999.

Smalley et al., "In search of the minimal *Escherichia coli* genome," *Trends in Microbiology*, 11(1):6-8, 2003.

Swartz, "Advances in *E. coli* production of therapeutic proteins," *Curr. Opin in Biotech*, 12:195-201, 2001.

Thomas et al., "Export of active green fluorescent protein to the periplasm by the twin-arginine translocase (TAT) pathway in *Escherichia coli,*" *Mol Micro*, 39(1):47-53, 2001.

Van Spanning et al., "Isolation and characterization of the moxJ, moxG, moxI, and moxR genes of Paracoccus denitrificans: Inactivation of moxJ, moxG, and moxR and the resultant effect on methylotrophic growth,"*Journal of Bacteriology*, 173(21):6948-6961, 1991.

Vellai et al., "Genome economization and a new approach to the species concept in bacteria," *Proc R Soc Lond B*, 266:1953-1958, 1999.

Venkatesan et al., "Complete DNA sequence and analysis of the large virulence plasmid of Shigella flexneir., "*Infection of Immunity*, 3271-3285, 2001.

Waller and Sauer, "Characterization of degQ and degS, *Escherichia coli* genes encoding homologs of the DegP protease," *Journal of Bacteriology*, 178(4):1146-1153, 1996.

Weiner et al., "A novel and ubiquitous system for membrane targeting and secretion of cofactor-containing proteins," *Cell*, 93:93-101, 1998.

Welch et al., "Extensive mosaic structure revealed by the complete genome sequence of uropathogenic *Escherichia coli,*" *Proc. Natl. Acad. Sci., USA*, 99(26):17020-17024, 2002.

Wirth et al., "Transformation of various species of gram-negative bacteria belonging to 11 different genera by electroporation," *Mol. Gen.Genet.*, 216:175-177, 1989.

Yang et al., "Metabolic flux analysis of *Escherichia coli* deficient in the acetate production pathway and expressing the bacillus subtilis acetolactate synthase," *Metabolic Engineering* 1:26-34, 1999.

Yu et al., "An efficient recombination system for chromosome engineering in *Escherichia coli,*" *Proc. Natl. Acad. Sci., USA*, 97:5978-5983, 2000.

Yu et al., "Minimization of the *Escherichia coli* genome using a Tn5-targeted Cre/LoxP excision system," *Nature Biotech*, 20:1018-1023, 2002.f.

Zhang et al., "A new logic for DNA engineering using recombination in *Escherichia coli,*" *Nature Genetics*, 20:123-128, 1998.

Zhang et al., "DNA cloning by homologous recombination in *Escherichia coli,*" *Nature Biotech.*, 18:1314-1317, 2000.

Zhang et al., "Phage annealing proteins promote oligonucleotide-directed mutagenesis in *Escherichia coli* and mouse ES cells," *BMC Molecular Biology*, 4:1, 2003.

INSERTION SEQUENCE-FREE BACTERIA

CROSS-REFERENCE TO RELATED APPLICATIONS

The present application is a continuation-in-part of U.S. application Ser. No. 11/275,094, filed Dec. 9, 2005, which in turn claims the benefit of U.S. Provisional Application No. 60/634,611, filed Dec. 9, 2004, and is a continuation-in-part of U.S. application Ser. No. 10/896,739 filed Jul. 22, 2004 (abandoned), which is a continuation of International Application No. PCT/US03/01800, filed Jan. 22, 2003, which claims the benefit of U.S. Provisional Application No. 60/409,089, filed Sep. 6, 2002 and which is a continuation-in-part of U.S. Application Ser. No. 10/057,582, filed Jan. 23, 2002, now U.S. Pat. No. 6,989,265.

FIELD OF THE INVENTION

The present invention relates to strains of microorganisms and processes involving these microorganisms. More specifically, the present invention relates to modified strains of microorganisms lacking all Insertion Sequence elements and the use thereof.

BACKGROUND OF THE INVENTION

Bacteria have been used to produce a wide range of commercial products. For example, many *Streptomyces* strains and *Bacillus* strains have been used to produce antibiotics; *Pseudomonas denitrificans* and many *Propionibacterium* strains have been used to produce vitamin B12; some other bacteria have been used to produce vitamins such as Riboflavin; *Brevibacterium flavum* and *Corynebacterium glutamicum* have been used to produce lysine and glutamic acid, respectively, as food additives; other bacteria have been used to produce other amino acids used as food additives; *Alcaligenes eutrophas* has been used to produce biodegradable microbial plastics; and many *Acetobacter* and *Gluconobacter* strains have been used to produce vinegar. More recently, bacteria, such as *Escherichia coli* (*E. coli*), have been genetically engineered and used as host cells for the production of biological reagents, such as proteins and nucleic acids, in laboratory as well as industrial settings. The pharmaceutical industry supports several examples of successful products, which are human proteins manufactured in *E. coli* cultures cultivated in a fermenter.

*E. coli* K-12 is the most commonly used host for cloning and other molecular biology techniques and is the platform of choice for production of metabolites such as amino acids and many proteins of therapeutic or commercial interest. Recently it has been used or proposed for production of therapeutic DNA for use in gene therapy, DNA vaccines, and RNA interference applications. The complete genomes of two closely related *E. coli* K-12 strains, MG1655 and W3110, have been sequenced and are available from the National Center for Biotechnology Information microbial genomes database (NCBI database) (www.ncbi.nih.gov/genomes/lproks.cgi) as accession numbers U00096 and AP009048 respectively. Eighty-seven percent of *E. coli* K-12 genes have been assigned functions with some degree of confidence, making it one of the best understood organisms.

Desirable properties for a platform microorganism include efficiency of production, purity of product and stability of the genome during experimental manipulation, in production, and in storage. The chromosome of *E. coli* is littered with mobile genetic elements that mediate horizontal gene transfer, including insertion sequences (IS), transposases, defective phages, integrases, and site-specific recombinases. These elements can translocate, duplicate, and be maintained in the genome like an infectious agent, and are known to hop into plasmids as well. IS elements may cause inversions, duplications, and deletions mediated by homologous recombination. This can happen even when the transposase function has become inactive. Similar rearrangements also result from rRNA and Rhs repeats, but the instability is magnified when active transposases are involved.

Genome alterations due to IS translocation occur surprisingly frequently, and many commonly used laboratory and industrial strains have unrecognized genome alterations from this cause. For example, many of the differences between the two sequenced *E. coli* K-12 strains, which have been separated for about five decades from a common laboratory ancestor, are due to IS hops. The sequence databases provide ample evidence that IS hopping into plasmids is also common on the time scale of laboratory manipulations. Approximately one in every thousand eukaryotic sequences in the public databases is inadvertently contaminated with bacterial IS elements that apparently hopped into the cloned eukaryotic DNA during the brief period of propagation in *E. coli* prior to sequencing.

IS elements can also be inadvertently introduced into strains by laboratory manipulations. A case in point involves the *E. coli* K-12 derivatives DH10B and DH5α, which carry an IS10 not present in the ancestral K-12 genome. Despite a report that residual IS10 elements do not exhibit transpositional mutagenesis in recA strains, such as DH10B and DH5α, the prominence of IS10 contamination of the eukaryotic databases shows that this continues to be an issue. Thus, IS elements may lead to unpredictable consequences with important production hosts and pose a considerable impediment to the efficiency and accuracy of amino acid, protein, and nucleic acid production in *E. coli.*

SUMMARY OF THE INVENTION

A non-naturally occurring bacterium is provided lacking genomic and non-genomic insertion sequences. The bacterium may be an *E. coli*. The genome of the bacterium may be less than 4.41 Mb, 4.27 Mb, 4.00 Mb, 3.71 Mb, 2.78 Mb or 1.86 Mb. The bacterium may be derived from strain *E. coli* K-12. The bacterium may also be derived from *E. coli* DH10B or *E. coli* DH5α. The bacterium may be competent to be transformed.

The bacterium may comprise an additional nucleic acid, which may lack insertion sequences. The additional nucleic acid may be a vector, which may be a plasmid. The additional nucleic acid may comprise another nucleic acid encoding a polypeptide. The polypeptide encoding nucleic acid may be operatively linked to an expression control sequence.

A method of propagating a nucleic acid is also provided. The nucleic acid may be toxic. A bacterium lacking genomic and non-genomic insertion sequences and an additional nucleic acid may be incubated under conditions allowing transformation of the bacterium with the nucleic acid which then may be grown under conditions allowing replication of the nucleic acid. Transformation may occur by electroporation. The nucleic acid may be amplified by propagating the bacterium, wherein the nucleic acid is amplified.

DETAILED DESCRIPTION

Figure 1:
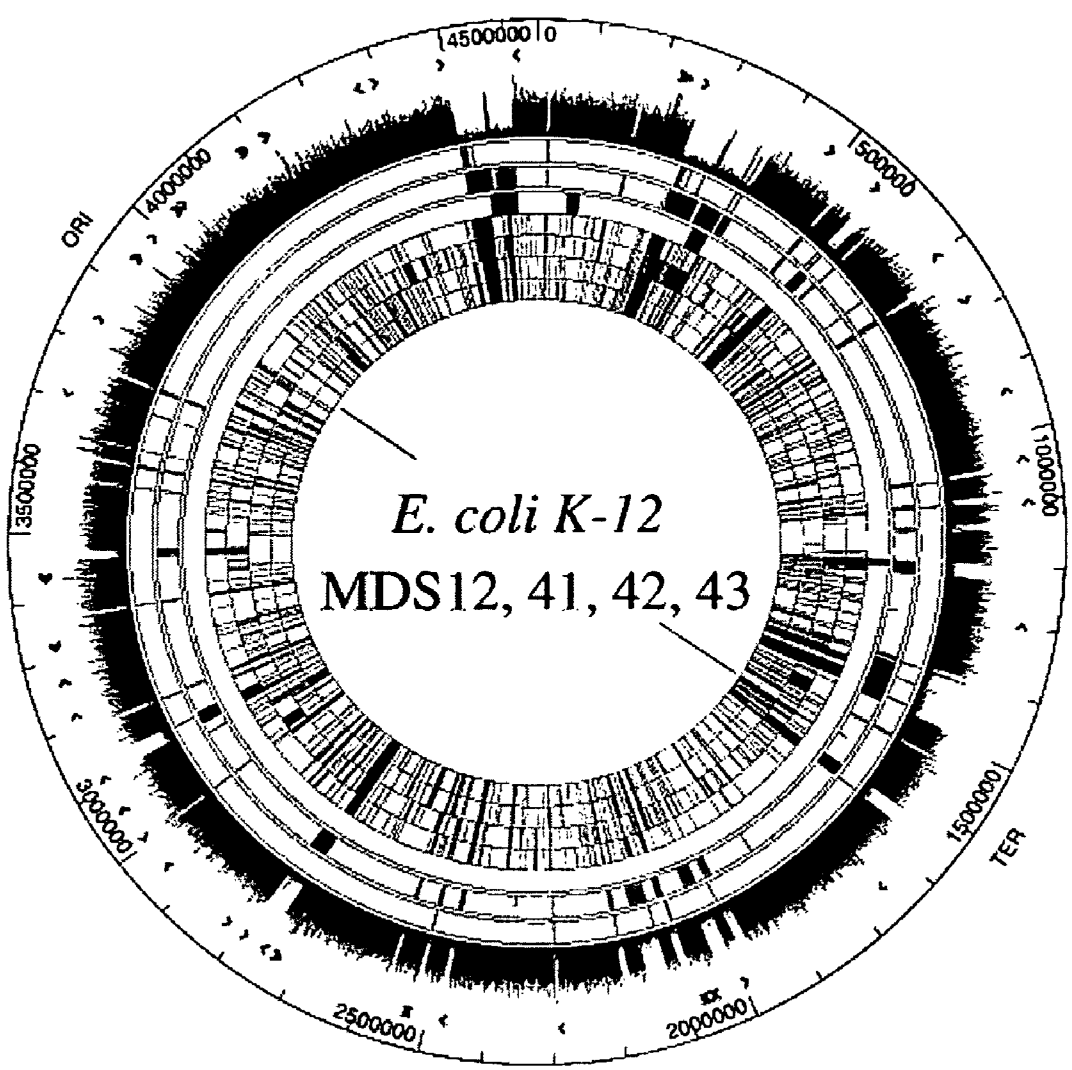
FIG. 1 is an illustration of the construction of an *E. coli* multiple deletion strain (MDS) lacking all IS elements. Concentric rings depict features mapped to the genome of the parental *E. coli* K-12 strain MG1655, numbered on the outer ring. Moving outward from the center, rings 1-5 (grey) show regions of K-12 that are absent in other sequenced *E. coli* genomes. Ring 6 shows the regions targeted for deletion. Ring 7 shows native IS and Rhs elements. Ring 8 shows experimental confirmation of the deletions in MDS43. The outer ring shows positions for the origin and terminus of replication and genes for rRNAs, tRNAs and other small stable RNAs.

The use of *E. coli* as a host organism for the production of biologically useful molecules has been plagued by genomic instability caused by mobile genetic elements such as IS elements. For example, IS elements can hop from host genomic nucleic acids into cloning vectors such as plasmids and thus are detrimental to the stability and efficiency of cloning. The role of extrachromosomal IS elements, such as IS mini-circles and other replicative and non-replicative IS derivatives is unappreciated and the presence of these in the host bacteria pose the same problem. A bacteria is provided lacking all genomic and non-genomic IS elements. The increased genetic stability of the bacteria is useful for such purposes as maintaining the integrity of cloned nucleic acids. The bacteria provides a more stable genetic environment for the production of nucleic acids, polypeptides, amino acids and other useful products.

1. Definitions

The terminology used herein is for the purpose of describing particular embodiments only and is not intended to be limiting. As used in the specification and the appended claims, the singular forms “a,” “an” and “the” include plural referents unless the context clearly dictates otherwise.

“Base pair” used herein may refer to the hydrogen bonded nucleotides of, for example, adenine (A) with thymine (T), or of cytosine (C) with guanine (G) in a double-stranded DNA molecule. In RNA, uracil (U) is substituted for thymine. Base pair may also be used as a unit of measure for DNA length.

“Clone” used in reference to an insert sequence and a vector may mean ligation of the insert sequence into the vector or its introduction by recombination either homologous, site specific or illegitimate as the case may be. When used in reference to an insert sequence, a vector, and a host cell, the term may mean to make copies of a given insert sequence. The term may also refer to a host cell carrying a cloned insert sequence, or to the cloned insert sequence itself.

“Complement,” “complementary” or “complementarity” used herein may mean Watson-Crick or Hoogsteen base pairing between nucleotides or nucleotide analogs of nucleic acid molecules. For example, the sequence 5'-A-G-T-3' is complementary to the sequence 3'-T-C-A-5'. Complementarity may be “partial”, in which only some of the nucleotides are matched according to the base pairing rules. Or, there may be “complete” or “total” complementarity between the nucleic acids. The degree of complementarity between nucleic acid strands may have effects on the efficiency and strength of hybridization between nucleic acid strands.

“Encoding” or “coding” used herein when referring to a nucleic acid may mean a sequence of nucleotides, which upon transcription into RNA and subsequent translation into protein, would lead to the synthesis of a given protein, peptide, or amino acid sequence. Such transcription and translation may actually occur in vitro or in vivo, or may be strictly theoretical based on the standard genetic code.

“Expression control sequence” used herein may mean a promoter or array of transcription factor binding sites that direct transcription of a nucleic acid operatively linked thereto.

“Nucleic acid” used herein may mean any nucleic acid containing molecule including, but not limited to, DNA or RNA. The term encompasses sequences that include any base analogs of DNA and RNA including, but not limited to, 4-acetylcytosine, 8-hydroxy-N-6-methyladenosine, aziridinylcytosine, pseudoisocytosine, 5-(carboxyhydroxylmethyl) uracil, 5-fluorouracil, 5-bromouracil, 5-carboxymethylaminomethyl-2-thiouracil, 5 carboxymethylaminomethyluracil, dihydrouracil, inosine, N6-isopentenyladenine, 1-methyladenine, 1-methylpseudouracil, 1-methylguanine, 1-methylinosine, 2,2-dimethylguanine, 2-methyladenine, 2-methylguanine, 3-methylcytosine, 5-methylcytosine, N6-methyladenine, 7-methylguanine, 5-methylaminomethyluracils, 5-methoxyaminomethyl-2-thiouracil, γ-D-mannosylqueosine, 5'-methoxycarbonylmethyluracil, 5-methoxyuracil, 2-methylthio-N6-isopentenyladenine, uracil-5-oxyacetic acid methylester, uracil-5-oxyacetic acid, oxybutoxosine, pseudouracil, queosine, 2-thiocytosine, 5-methyl-2-thiouracil, 2-thiouracil, 4-thiouracil, 5-methyluracil, N-uracil-5-oxyacetic acid methylester, uracil-5-oxyacetic acid, pseudouracil, queosine, 2-thiocytosine, and 2,6-diaminopurine.

“Operably linked” used herein may refer to an expression control sequence and downstream polynucleotide, such that productive transcription of the polynucleotide is initiated at the expression control sequence.

“Overexpressing” used herein may mean that the total cellular activity of protein encoded by a gene is increased. The total cellular activity of a protein may be due to increased cellular amounts of a protein, or increased half-life of the protein. Total cellular amounts of a protein may be increased by methods including, but not limited to, amplification of the gene coding said protein, operatively linking a strong promoter to the gene coding said protein or by increasing the strength of the genes' native promoter by, for example, mutating the promoter.

"Plasmid" used herein may mean extrachromosomal genetic elements composed of DNA or RNA that are not part of a chromosome but can propagate themselves autonomously in cells. A plasmid may refer to not only those native plasmids isolated from cells, but also any modified or chimeric versions (e.g., having deletions, additions or substitutions or assembled from functional parts of different plasmids) so long as they retain the ability to propagate themselves autonomously in cells.

"Phage" used herein may mean extrachromosomal bacteriophage capable of propagating in cells, such as bacteriophage P1, and also includes lysogenic bacteriophage such as Lambda that can integrate into, and propagate within, the host chromosome. A phage may refer to not only naturally occurring bacteriophage, but also any modified or chimeric versions (e.g. having deletions, additions or substitutions or assembled from functional parts of different phage) so long as they retain the ability to propagate in cells either autonomously or with helper function provided, for example, by helper phage.

"Protein" used herein may mean a peptide, polypeptide and protein, whether native or recombinant, as well as fragments, derivatives, homologs, variants and fusions thereof.

"Region of comparison" used herein when referring to a genome may be $1\times10^7$, $1.5\times10^7$, $2\times10^7$, $2.5\times10^7$, $3.5\times10^7$, $4\times10^7$ or more nucleotides or base pairs, and when referring to a nucleic acid sequence may be 50, 100, 250, 500, $10^3$, $5\times10^3$, $10^4$, $5\times10^4$, $10^5$, $5\times10^5$, $10^6$ or more nucleotides or more base pairs.

"Substantially complementary" used herein may mean that a first sequence is at least 60%, 65%, 70%, 75%, 80%, 85%, 90%, 95%, 97%, 98%, or 99% identical to the complement of a second sequence over a region of comparison or that the two sequences hybridize under stringent hybridization conditions.

"Substantially identical" used herein may mean that a first and second sequence are at least 60%, 65%, 70%, 75%, 80%, 85%, 90%, 95%, 97%, 98%, or 99% identical or substantially complementary over a region of comparison. A reference sequence and a test sequence may be aligned, manually or by a computer algorithm (e.g., GAP, BESTFIT, FASTA and TFAST), and the percentage identity calculated by dividing "the total number of identical residues" by "the total number of residues in the reference sequence" and then multiplying by 100.

"Vector" as used herein may mean a carrier DNA molecule into which a nucleic acid sequence can be inserted for introduction into a new host cell where it may be replicated, and in some cases expressed. Vectors can be derived from plasmids, bacteriophages, plants, animals viruses, etc. The vector may be propagated in the host cell as an extrachromomal element or, alternatively, the vector may integrate into the host cell genome and produce additional copies of the nucleic acid molecules when the host cell replicates.

2. Bacteria Lacking Insertion Sequences

A non-naturally occurring bacteria is provided lacking genomic and non-genomic IS elements. IS elements and their associated transposases are often found in bacteria and are associated with instabilities that can interfere with standard industrial or laboratory practices and might entail costly and burdensome quality control procedures. IS elements may be contained not only in genomic host nucleic acids, but also in non-genomic host nucleic acids.

An IS element may be linear or circular. For example, the IS element may be circularized to form an IS-mini circle. Creation of IS mini-circles may be the first step in the transposition process of an IS element. For example, creation of an IS-mini-circle is the first step in the transposition process of IS elements belonging to the IS2 family. IS elements are common in *E. coli* and all of them may be deleted.

IS elements are currently grouped into families based on conserved motifs. IS families include, without limitation, IS, IS3, IS4, IS5, IS6, IS2J, IS30, IS66, IS91, IS110, IS200/605, IS256, IS481, IS630, IS982, IS1380, ISAs1, ISL3, Tn3, and variants thereof. A variant may contain any of the conserved regions that define any of the IS families. Representative conserved regions include, but are not limited to the DDE motif, conserved in most IS element families, and the N-terminal helix-turn-helix motif, conserved in members of the IS3 family. The ISFinder database (www-is.biotoul.fr) contains the sequences of various members of the IS families. Each member of each IS family may be deleted.

a. Parent

The parent of the ISfree bacteria may be any bacterial strain that contains IS elements, as well as an intermediate strain from which the bacterium is derived. Representative examples of parent strains include, but are not limited to, *E. coli* strains such as K-12 or B, or a strain with a genome sequence substantially identical thereto. The *E. coli* K-12 strain may be a derivative strain including, but not limited to MG1655, DH10B, DH5α, Invα, Top10, Top10F, JM103, JM105, JM109, MC1061, MC4100, XL1-Blue, EC100 or EC300. The nucleotide sequence of the genome of the parental strain may be partially or completely known. The complete genomic sequence of several strains of *E. coli* and other commonly used laboratory microorganisms is known (see, e.g., Blattner et al., *Science,* 277:1453-74, 1997; GenBank Accession No. U0096; NCBI database, Accession No. AP009048, Perna et al., *Nature,* 409, 529-533, 2001; Hayashi et al., *DNA Res.,* 8, 11-22, 2001; Welch et al., *Proc. Natl. Acad. Sci., USA* 99:17020-17024, 2002 and GenBank Accession No. AE014075, each of which is incorporated herein by reference). The genomic sequence of DH10B is partially known (www.hgsc.bcm.tmc.edu/projects/microbial/EcoliDH10B).

*E. coli* strains MG1655 and W3110 have been sequenced and each contains a variety of IS elements, including: IS1, a member of the IS1 family; IS2, IS3 and IS150, members of the IS3 family; IS4 and IS 186, members of the IS4 family; IS5, a member of the IS5 family; and IS30, a member of the IS30 family. Additionally, partial sequences of IS600 and IS911, members of the IS3 family, are found in each strain. Frequency of occurrences of IS elements are presented in Table 1. Because DH10B is an *E. coli* K12 derivative, it is expected to have a similar IS composition to MG1655 and W3110.

TABLE 1

Frequency of IS elements in select *E. coli* K-12 strains

| IS element | MG1655 | W3110 | DH10B |
|---|---|---|---|
| IS1 | 7 | 8 | present |
| IS2 | 6 | 10 | present |
| IS3 | 5 | 5 | present |
| IS4 | 1 | 1 | present |
| IS5 | 11 | 18 | present |
| IS30 | 3 | 3 | present |
| IS150 | 1 | 1 | present |
| IS186 | 3 | 3 | present |

TABLE 1-continued

| Frequency of IS elements in select *E. coli* K-12 strains | | | |
|---|---|---|---|
| IS element | MG1655 | W3110 | DH10B |
| IS600 | partial | partial | ? |
| IS911 | partial | partial | ? |
| IS10 | 0 | 0 | present |

The nucleic acid sequence of *E. coli* MG 155 (annotated version m56), (NCBI accession no. U00096.1) is set forth in SEQ ID NO: 1 with a total size of 4,639,675 nucleotides or base pairs. The original release of the genomic sequence of *E. coli* MG1655 was annotated version m54, (NCBI accession no. U00096.1) (4,639,221 nucleotides or base pairs). Positions of the IS elements on a genome map of *E. coli* MG1655 (annotated version m54) are shown in FIG. 1 and Table 2 of U.S. Patent Publication No. 20030138937 and International Patent Publication No. WO 2003/070880, the contents of which are incorporated herein by reference.

b. Genomic Deletions

The bacteria may be made by deleting IS elements using any of the several methods known to those of skill in the art for deleting genomic or non-genomic nucleic acid. The nucleic acid sequences may be deleted from genomic or from non-genomic genetic material.

Representative methods for making deletions in the genome of a bacterium are described in U.S. Patent Publication No. 20030138937 and International Patent Publication No. WO 2003/070880, Posfai, G. et al., *J. Bacteriol.* 179: 4426-4428 (1997), Muyrers, J. P. P. et al., *Nucl. Acids Res.* 27:1555-1557 (1999), Datsenko K. A. et al., *Proc. Natl. Acad. Sci.* 97:6640-6649 (2000) and Posfai, G. et al., *Nucl. Acids. Res.* 27: 4409-4415 (1999), each of which is incorporated herein by reference. The deletion methods may be classified to those that are based on linear DNA and those that are based on suicide plasmids. The methods disclosed in Muyrers, J. P. P. et al., *Nucl. Acids Res.* 27:1555-1557 (1999) and Datsenko, K. A., *Proc. Natl. Acad. Sci.* 97:6640-6649 (2000) are linear DNA-based methods and the methods disclosed in n Posfai, G. et al., *J. Bacteriol.* 179: 4426-4428 (1997) and Posfai, G. et al., *Nucl. Acids Res.* 27: 4409-4415 (1999) are suicide plasmid-based methods.

In addition to IS elements, additional nucleic acids regions may be deleted from the bacteria. For example, in addition to IS elements, the bacteria may also be lacking one or more of the nucleic acid regions set forth on Table 2, or sequences substantially similar thereto, and those set out in Table 1 of U.S. Provisional Application No. 60/709,960, incorporated herein by reference. The bacteria may be strain MDS39, MDS41, MDS42, MDS43, or a strain with a genome substantially identical thereto. FIG. 1 is a map of MDS41, MDS42, and MDS43, all of which lack IS elements. The bacteria may also be MDS42recA or a strain with a genome substantially identical thereto. The bacteria may have a genome that is less than 4.41 Mb, 4.27 Mb, 4.00 Mb, 3.71 Mb, 2.78 Mb, or 1.86 Mb. Elimination of unnecessary genes may improve metabolic efficiency and perhaps simplify the purification of desirable products.

c. Competent Bacteria

The bacteria may be competent for transformation by a foreign molecule, such as a nucleic acid. The bacteria may be made competent by methods well known in the art. Representative methods of making the bacteria competent may be found in U.S. Pat. No. 4,981,797 and U.S. Patent Publication No. 20050032225, which are hereby incorporated by reference.

Removal of IS elements may lead to increased electroporation efficiency. For example, electroporation efficiency of strains MDS41, MDS42, and MDS43, from which all genomic IS elements are deleted, is improved by 2 orders of magnitude over their MG1655 parent and is comparable to DH10B, normally considered to be the best *E. coli* for electroporation.

d. Bacteria Comprising a First Nucleic Acid

The bacteria may comprise an additional nucleic acid, which may lack IS elements. The additional nucleic acid may be a vector, which may, inter alia be a plasmid, cosmid, BAC, modified YAC, phagemid or phage. The vector may be a cloning vector or an expression vector.

The additional nucleic acid may comprise another nucleic acid encoding a polypeptide. The polypeptide may be a therapeutic product including, but not limited to, a vaccine component, a diagnostic product, or a research reagent. Further, the polypeptide may be a protein, including but not limited to, insulin, an interleukin, a cytokine, a growth hormone, a growth factor, erythropoietin, a colony stimulating factor, interferon, an antibody and an antibody fragment. Expression of the polypeptide may be under the control of an inducible promoter or a promoter that is constitutively expressed in the bacteria. For example, lac-based promoter/repressor, inducible by the non-metabolisable galactose derivative, IPTG, may be used.

A first nucleic acid lacking IS elements may be useful for cloning. For example, overexpressing even a well tolerated protein-of-interest may lead to elevated IS transposition rates. Such transposition may result in the insertion of an IS element into the nucleic acid encoding the protein-of-interest.

3. Methods a. Cloning

The bacteria may be used to clone a nucleic acid. Briefly, the competent bacteria may be incubated with a nucleic acid under conditions allowing transformation of the bacteria by the nucleic acid. Conditions allowing transformation are well known in the art and may include, but are not limited to, electroporation, calcium or manganese chloride precipitation, lipofection, microinjection and natural transformation.

By providing a bacteria lacking genomic and non-genomic IS elements, cloning artifacts caused by transposable IS elements may be eliminated. Toxic nucleic acids may therefore be cloned in the bacteria. A "toxic" nucleic acid may be a nucleic acid which, when propagated in a host strain, results in an elevated rate of IS element transposition. Toxic nucleic acids are difficult to clone in bacterial hosts containing IS elements. For example, a nucleic acid encoding the open reading frame of VP60 of rabbit haemorrhagic disease virus fused to the B subunit of cholera toxin, previously incapable of being cloned due to the high rate of IS element transposition, has been successfully cloned in IS-free bacteria. In another example, pT-ITR, a plasmid possessing a stem-loop structure that prevents propagation in bacterial hosts containing IS elements, has been successfully propagated in IS-free bacteria.

Because IS element transposition may result in detectable insertion mutations, an elevated rate of IS element transposition of a toxic nucleic acid may be determined by comparison to the mutation rate of a host strain propagating a control nucleic acid. The insertion mutation rate of a host strain propagating the nucleic acid may be measured by the appearance of mutant cells that gain the ability to utilize salicin as a carbon source. Metabolism of salicin in *E. coli* K-12 requires activation of the bgl operon, which occurs primarily by integration of an IS element into the promoter region, as described in Hall, *Mol. Biol. Evol.,* 15:1-5, 1998, which is incorporated herein by reference. The toxic nucleic acid may encode a polypeptide, in which case the rate of IS element transposition may be compared to that resulting from the propagation, in the same host strain, of a control nucleic acid of similar size encoding a different polypeptide. The toxic nucleic acid may also be a vector, in which case the rate of IS element transposition may be compared to that resulting from the propagation, in the same host strain, of a different vector of similar size. Representative vectors include, but are not limited to pBR322, pUC18, pGEM, and pBluescript.

b. Expression

The bacteria may also be used for the production of polypeptides. Briefly, a bacteria comprising an additional nucleic acid which comprises a nucleic acid encoding a polypeptide, as described above, may be incubated under conditions allowing expression of the polypeptide product.

Overexpression of even a well tolerated protein-of-interest may lead to elevated IS transposition rates. Such transposition may result in the insertion of an IS element into the nucleic acid encoding the protein-of-interest. A bacteria comprising a nucleic acid encoding a polypeptide and lacking genomic and non-genomic IS elements may provide an increased production of protein.

Recombinant proteins may be expressed in the periplasm or cytoplasm. The expression of proteins in the periplasm is routinely used for industrial use and has been reviewed in Hanahan, *J. Mol. Biol.,* 166:557-80, 1983; Hockney, *Trends Biotechnol.,* 12:456-632, 1994; and Hannig et al., *Trends Biotechnol.,* 16:54-60, 1998, each of which is incorporated herein by reference. Recombinant proteins may be produced in the periplasm by expressing fusion proteins in which they are attached to a signal peptide that causes secretion into the periplasmic space. There the signal peptide may be cleaved off by specific signal peptidases. The protein transported into the periplasmic space may be biologically active.

The recombinant protein may also be co-expressed with chaperones/disulfide-bond forming enzymes, which may provide proper folding of the recombinant protein. Nucleic acid sequences of such proteins useful for periplasmic expression of recombinant protein include, but are not limited to, those described in U.S. Pat. Nos. 5,747,662; 5,578,464; 6,335,178; and 6,022,952; Thomas et al., *Mol-Micro*, (2001) 39 (1) 47-53; Weiner et al., *Cell*, (1998) 93, 93-101; and Current Protocols in Molecular Biology (1994) 16.6.1-16.6.14 (Copyrighted 2000 by John Wiley et al. and Sons), each of which is incorporated herein by reference.

c. Amplification

The reduced genome strain may also be used to amplify a nucleic acid. Briefly, a bacteria comprising a first nucleic acid lacking IS elements, may be incubated under conditions allowing the propagation of the first nucleic acid lacking IS elements.

The present invention has multiple aspects, illustrated by the following non-limiting examples.

EXAMPLE 1

Production of MDS39

Reduced genome strain MDS39 was produced as described in International Patent Publication No. WO 2003/070880, which is incorporated herein by reference. Briefly, a series of reduced genome strains (MDS01-MDS39) were produced by constructing a series of cumulative deletions of nucleic acid sequences from the parental strain *E. coli* MG1655 (annotated version m56)(SEQ ID NO: 1).

EXAMPLE 2

Production of MDS40-MDS43

Hybridization to genome scanning chips (NimbleGen Systems, Madison, Wis.) containing the K-12 sequence and all sequences in the IS database revealed that MDS39, the first strain designed to lack all IS elements, unexpectedly contained additional copies of IS elements that had hopped to new locations during its production. These IS elements were deleted to produce MDS40. The fhuACDB (the tonA locus) was deleted from MDS40 to produce MDS41. Strains lacking the tonA locus are resistant to infection by bacteriophage T1, a common laboratory scourge. The endA gene was deleted from MDS41 to produce MDS42. Loss of the endA-encoded endonuclease facilitates plasmid preparation. MDS43 was produced by deleting an additional 45 kb covering the lac operon from parental strain MDS42. The resulting MDS strains were again characterized by DNA chip hybridization. As shown in FIG. 1, for MDS43 (and for MDS41 and 42; data not shown) there is no evidence for any contaminating IS elements. Rings depict features mapped to the genome of the parental *E. coli* K-12 strain MG1655, numbered on the outer ring. Moving outward from the center, rings 1-5 (grey) show regions of K-12 that are absent in other sequenced *E. coli* genomes: RS218, CFT073, *S. flexneri* 2457T, EDL933 and DH10B. Ring 6 shows the regions targeted for deletion: MDS12 (red), MDS41 (yellow), MDS42 (blue), and MDS43 (purple); half-height black bars indicate 4 rogue IS elements detected and cleanly removed during strain construction. Ring 7: native IS (green) and Rhs elements (light blue). Ring 8: experimental confirmation of the deletions in MDS43 by a NimbleGen tiling chip; probes corresponding to the intended deletions are colored green, other probes are colored red. On the outer ring the positions of the origin and terminus of replication and genes for rRNAs (blue), tRNAs (turquoise) and other small stable RNAs (black) are indicated. The genome characteristics of new MDS strains MDS41-43 are summarized in the Table 3:

TABLE 3

Genome statistics of MG1655 and related multiple deletion strains

| | MG1655 | MDS12 | MDS41 | MDS42 | MDS43 |
|---|---|---|---|---|---|
| total no. genes | 4444 | 4029 | 3743 | 3742 | 3704 |
| genome size (bp) | 4639675 | 4263492 | 3977067 | 3976359 | 3931408 |
| replichore imbalance (bp) | 30517 | 141360 | 139331 | 138623 | 183574 |
| total no. genes deleted | 0 | 415 | 701 | 702 | 740 |
| total bp DNA deleted | 0 | 376183 | 662608 | 663316 | 708267 |
| % genome deleted | 0 | 8.11% | 14.28% | 14.30% | 15.27% |
| total no. ISs deleted | 0 | 22 | 42 | 42 | 42 |

EXAMPLE 3

Detection of IS Contamination of Plasmid Preparations

Figure 2:
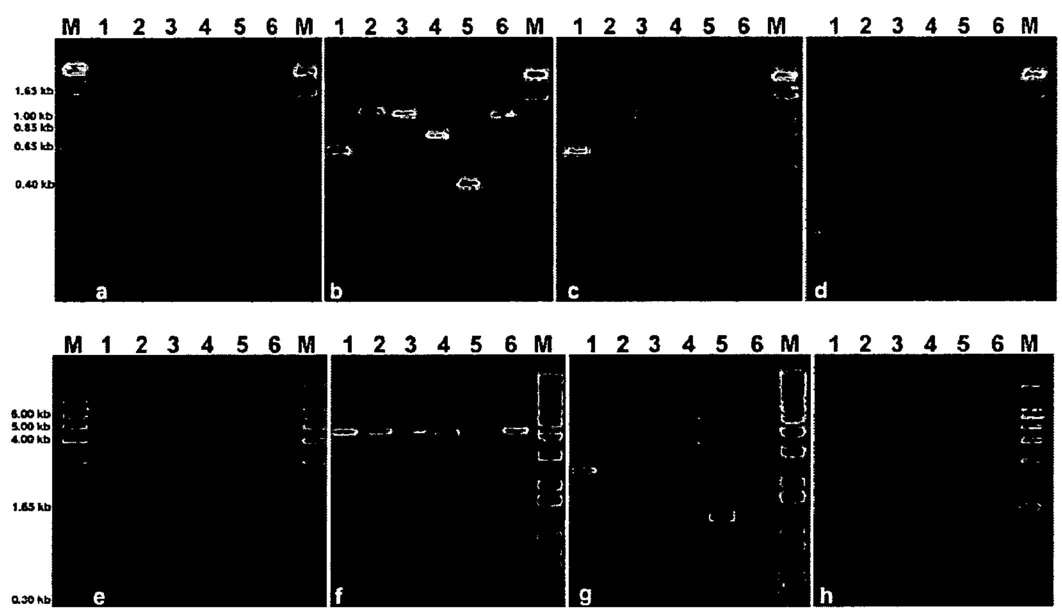
FIG. 2 shows the PCR detection of IS elements in various DNA preparations. Each panel is loaded in the same order: 1 kb+ marker, IS1, IS2, IS3, IS5, IS10, IS186, 1 kb+ marker, for (1) Positive Control, (2) Negative Control, (3) pBR322 from Invitrogen (in DH10B), and (4) pBR322 produced in MDS42.

A commercial preparation of pBR322 plasmid DNA, grown on DH10B according to the manufacturer, was compared to MDS grown plasmid. PCR amplification was done with inward and outward primers specific for IS1, IS2, IS3, IS5, IS10 and IS186 (FIG. 2, lanes 1-6 respectively; M is 1 kb+size standard). Outward primers (FIG. 2, panels e-h) detect circular structures, whereas inward primers (FIG. 2, panels a-d) detect both linear and circular IS forms. Positive controls were constructed by cloning each IS type (minus about 20 base pairs from its ends to prevent mobilization) into pBR322 (FIG. 2, panels b and f). FIG. 2, panels a and e are negative controls containing no DNA. Both sets of primers detected IS elements in the DH10B-grown prep (FIG. 2, panels c and g). The circular forms include some with sizes expected for a simple insertion of the IS into the plasmid, while others are consistent with a circle the size of the element itself. Cloning and sequencing further characterized products of the outward primer reactions. IS1, IS2, IS5 and IS10 gave examples of simple insertions at various positions in the plasmid. To detect mini-circle forms of IS elements, outward primed PCR reactions were directly sequenced with one of the primers. IS2 gave sequence results consistent with the presence of mini-circles. Plasmids grown in MDS42, on the other hand, contained no contaminating IS elements (FIG. 2, panels d and h). This indicates that removal of IS elements from host nucleic acids eliminates the hopping of IS elements from host nucleic acids to plasmid nucleic acids during cloning.

EXAMPLE 4

Figure 3:
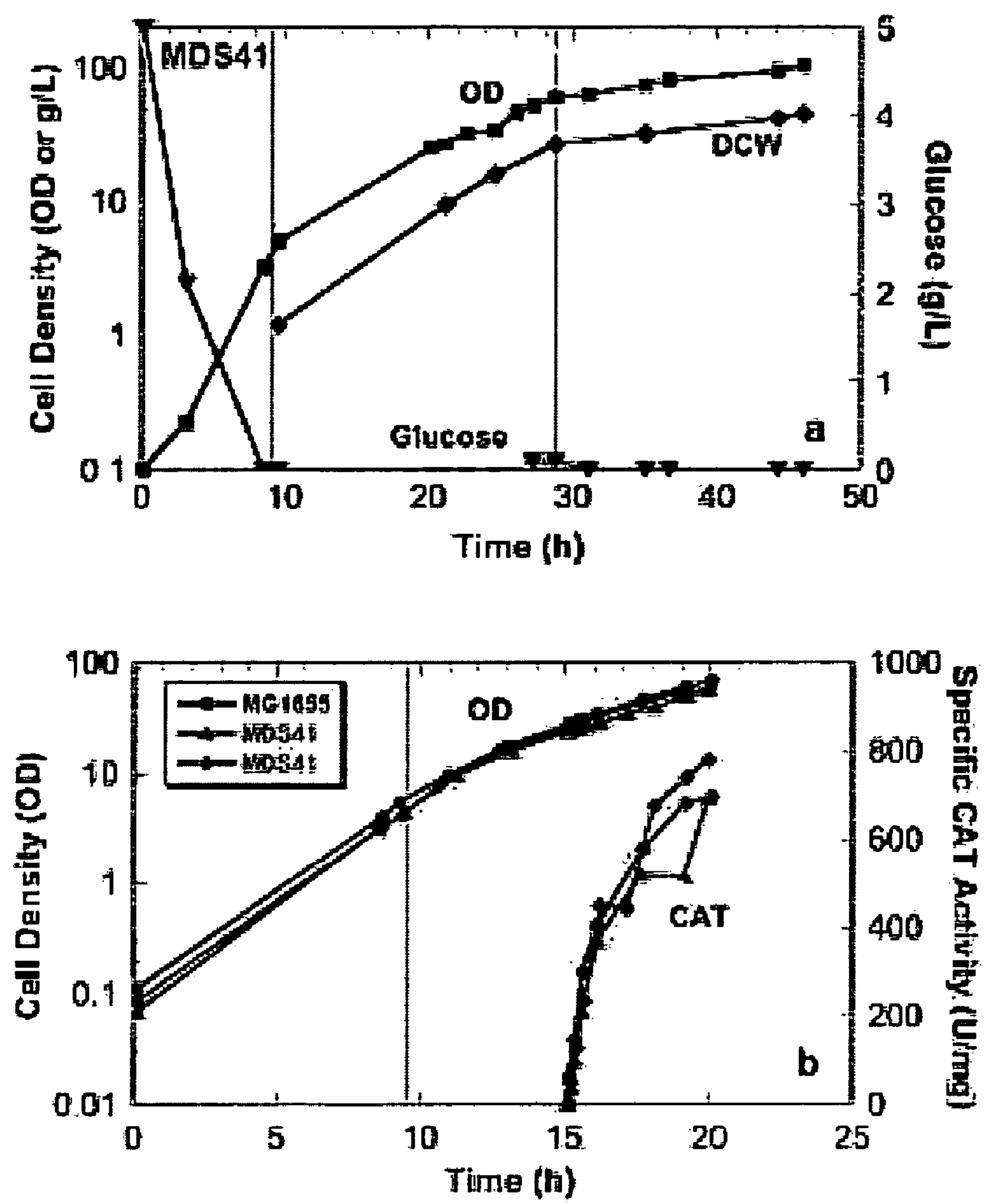
FIGS. 3*a* and 3*b* show the growth rate of strains MDS41, MDS42 and MDS43 in MOPS minimal medium at 37° C. (top) and a comparison of the growth rates and CAT expression of MG1655 and MDS42 in MOPS minimal medium at 37° C. (bottom).

Growth Rate of and Recombinant Protein Production in Strains Lacking IS Elements Strains MDS41, MDS42 and MDS43 were characterized for growth in standard microbiological media. FIG. 3(*a*) shows that each of the MDS strains can be grown to high cell densities in fed-batch fermentations on minimal medium. MDS41 was cultured in a minimal medium. Three growth phases were used to reach a dry cell weight (DCW) of 44 g/l. The first phase was a simple batch process. The second phase was a fed-batch process where the growth rate was controlled to 0.15 $h^{-1}$. The third growth phase (also a fed-batch process) had a significantly lower controlled growth rate to prevent exceeding the oxygen transfer rate of the fermenter. For the targeted cell density, a controlled growth rate of 0.03 $h^{-1}$ was used. FIG. 3(*b*) shows that the growth rate of MDS42 was essentially unchanged relative to the parental strain MG1655 in MOPS minimal medium at 37° C. Doubling time was obtained by measuring OD600 of cultures grown in baffled flasks at 37° C. The log linear portion of the growth curve was used to calculate the average doubling times and standard deviation from six replicates on the plate. The doubling time of MG1655 was 61.3 minutes compared to a doubling time of 69.07 minutes for MDS42. FIG. 3(*b*) shows that expression of recombinant proteins was similar for the MDS and MG1655 strains based on expression of the model protein chloramphenicol acetyl transferase (CAT).

EXAMPLE 5

Transformation Efficiency of Strains Lacking IS Elements

Strain MDS42 was compared to MG1655 and DH10B for transformation efficiency. Cells were grown under standard growth conditions to an optical density of 2.0 at 600 nm. Electrocompetent cells were prepared according to the method of Dower et al., Nucleic Acids Res (1988) 16, 6127-6145, incorporated herein by reference, and stored as frozen aliquots in 15% glycerol at a final optical density of 200 at 600 nm. Electroporation in an Eppendorf model 2510 instrument was at 18 kv/cm using 0.1 pg pUC 19 or 50 pg pCC145 DNA added to 0.1 ml of competent cells. The median of five electroporations is presented, each with a different batch of competent cells. For commercial competent cells of DH10B the five determinations were from different tubes of the same batch. With 20 kV/cm as recommended by their manufacturer, the commercial cells gave slightly higher values of $82.3\times10^8$ for pUC19 and $6.1\times10^6$ for pCC145 DNA. A t-test (p=0.002) indicates the transformation efficiency of MDS42 is significantly improved over MG1655 for electroporation with both large and small plasmid DNAs. As shown in Table 4, MDS42 has a substantially higher transformation efficiency compared to MG1655. Commercial competent cells are indicated by *:

TABLE 4

| Electroporation Efficiency (transformants/μg DNA) | | |
|---|---|---|
| Strain | pUC19 (2.686 kb) | pCC145 (pCC1BAC ™-145; Epicentre) (153 kb) |
| MG1655 | $0.7 \times 10^8$ | 0 |
| DH10B | $35.0 \times 10^8$ | $1.9 \times 10^6$ |
| DH10B* | $35.4 \times 10^8$ | $6.5 \times 10^6$ |
| MDS42 | $130.0 \times 10^8$ | $10.0 \times 10^6$ |

EXAMPLE 6

DNA Stability in Strains Lacking IS elements

Figure 4:
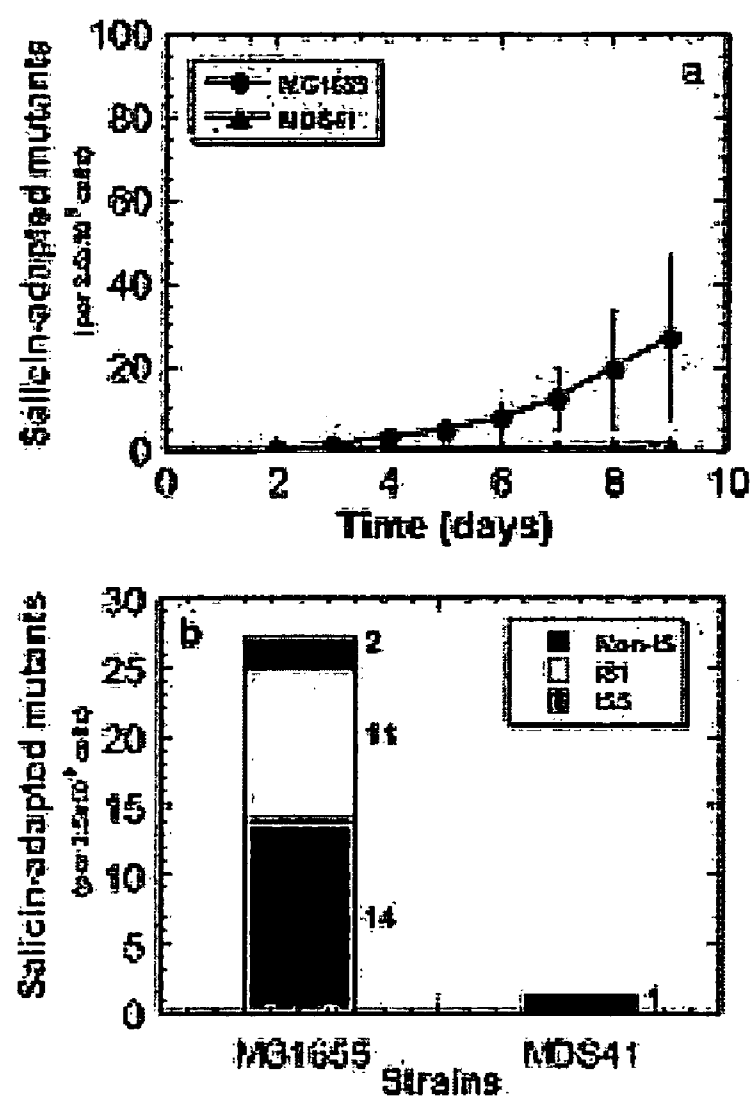
FIG. 4 compares the frequency of mutation by IS hopping to the genome in MDS41 and MG1655 as measured by the acquired ability to utilize salicin as a carbon source.

FIG. 4(*a*) shows that the measured frequency of mutation by IS hopping dropped to zero in strains lacking IS elements. Briefly, populations of MDS41 and parental MG1655 were monitored for appearance of mutant cells that gained the ability to utilize salicin as a carbon source. Metabolism of salicin in *E. coli* K-12 requires activation of the bgl operon, which occurs primarily by integration of an IS element into the promoter region. Cell populations were grown to saturation in glucose/minimal medium, then spread on minimal plates containing salicin as the sole carbon source. New colonies (adaptive mutants) were marked and counted each day for 9 days. The data shown in FIG. 4(*a*) are the mean from three independent experiments. Total plated cell numbers were calculated by plating appropriate dilutions from 2-5 parallel cultures onto rich medium. The mean colony numbers were normalized to $2.5\times10^9$ cells. A two-factor ANOVA analysis ($\alpha \leqq 0.05$) with post-hoc (t-tests) was used to determine if the adaptation rates (the mutant number/day) were significant with respect to strain or time. Both the time and strain/plasmid were determined to be significant ($p \leqq 0.001$). The interaction of time and strain/plasmid was determined not to be significant. Relative to MG1655, MDS41 displayed a >92% decrease in the rate of activation of the bgl operon. PCR analysis of the adaptive mutants indicates the decrease is due to the complete absence of IS-generated mutations in MDS41. FIG. 4(*b*) shows the spectrum of mutations in the bglR region of MG1655 and MDS41 cells adapted to salicin/minimal medium on day 9.

EXAMPLE 7

Stability of BAC libraries in Strains Lacking IS elements

Many large-scale sequencing projects of medical and commercial importance rely on large insert libraries commonly referred to as Bacterial Artificial Chromosomes (BACs). These recombinant constructs are composed of very large contiguous sequences of the subject DNA, on the order of 100 kb or larger, in combination with a selectable marker and a stable, low-copy number origin of replication to allow the molecule to replicate in a bacterial host. These molecules represent large targets for IS element insertion and are frequently subject to IS-mediated rearrangements, including deletions and inversions, which are difficult to detect by electronic bioinformatics methods. Minimizing bacterial DNA contamination (via IS element movement) represents an enormous improvement in the utility of BAC strategies for sequencing genomes. IS free strains of *E. coli* allow a precise measurement of the extent to which IS elements contaminate BAC DNA libraries.

A human BAC library created and maintained in *E. coli* DH10B was used to test the extent of IS element incorporation in BAC DNA. Forty-five random clones were picked from the 32,000 clone tiled human library collection and grown overnight in 1 ml LB cultures supplemented with chloramphenicol. BAC DNA was prepared using an Autogen 9600 robot. Each purified BAC DNA was subsequently transformed into the IS free MDS42recA host and approximately 384 colonies of each transformant were transferred to several duplicate Nylon membranes for hybridization screening with transposon specific probes.

In addition to the 45 independent BAC clones, three types of controls were also hybridized to membranes. These include a positive control (a) consisting of 384 individual *E. coli* DH10B colonies that did not contain any plasmid or BAC DNA. Two additional controls involved transformation of BAC DNA directly into the IS free MDS42recA strain, so that these BACs have never been grown in a bacterial host containing IS elements. The first of these controls (b) consisted of an approximately 150 kb BAC clone isolated from MDS42recA and subsequently re-transformed into the same bacterial host, 384 colonies of which were then transferred to Nylon membranes for hybridization analysis. A final control (c) involved the same BAC DNA, but rather than directly transforming this DNA into the IS-free host, the BAC DNA was mixed with an extract of DH10B produced by the Autogen robot containing only host chromosomal DNA fragments. This mixture was then transformed into the IS-free host and 384 of the resulting transformants were arrayed on a Nylon membrane for hybridization analysis. These three controls test the ability of the analysis to differentiate IS elements present in host chromosomal DNA versus BAC or plasmid DNA (control a), the lack of IS elements in BAC DNA that has never been propagated in an IS containing host (control b), and whether IS elements can be transferred in vitro, or by co-transformation with linear chromosomal DNA that contains IS elements (control c). Altogether 48 BAC combinations were tested, including 45 samples and 3 controls by arraying approximately 384 transformants of each BAC onto Nylon membranes for a total of 18,046 hybridization targets.

Probes for each of six IS element classes known to be present in *E. coli* DH 10B were designed to test the Nylon membranes for the presence of IS elements within the BAC DNA. These probes were produced by synthesizing two overlapping complimentary oligonucleotides which, when annealed leave single stranded overhangs which can be subsequently filled using the Klenow fragment of DNA polymerase in the presence of radio-labeled nucleotides to produce high specific activity double stranded probes specific to the most highly conserved region of each of the six IS classes. The oligonucleotide and corresponding probe sequences are shown in Table 5.

TABLE 5

Probe designs for IS1, IS2, IS3, IS5, IS10 and IS186 family detection

| IS | Oligo | Primer sequence | Probe sequence |
|---|---|---|---|
| IS1 | IS1-Ova | 5'CTTATGAGCCTGCTGTCACCCTTT | 5'CTTATGAGCCTGCTGTCACC- |
| | IS1-OVb | 5'TCCATATCACCACGTCAAAGGGTG | CTTTGACGTGGTGATATGGA |
| IS2 | IS2-OVa | 5'GTGGCTGACGGATAATGGTTCATG | 5'GTGGCTGACGGATAATGGTT- |
| | IS2-OVb | 5'TTCATTAGCCCGGTAGCATGAACC | CATGCTACCGGGCTAATGAA |
| IS3 | IS3-OVa | 5'CAGACGTCTTCTGAACGTGAACTG | 5'CAGACGTCTTCTGAACGTGA- |
| | IS3-OVb | 5'TCTCGGTAGACATCTCCAGTTCAC | ACTGGAGATGTCTACCGAGA |
| IS5 | IS5-OVa | 5'GAGCAGATTCTGCCATGGCAAAAC | 5'GAGCAGATTCTGCCATGGCA- |
| | IS5-OVb | 5'CGATGACTTCCACCATGTTTTGCC | AAACATGGTGGAAGTCATCG |
| IS10 | IS10-OVa | 5'ATTGCGAGCTTCAGTCGCACTACA | 5'ATTGCGAGCTTCAGTCGCAC- |
| | IS10-OVb | 5'AGTAACAGAACGACCGTGTAGTGC | TACACGGTCGTTCTGTTACT |
| IS186 | IS186-OVa | 5'TTGCGTGCAAAGGAACCTGAACTC | 5'TTGCGTGCAAAGGAACCTGA- |
| | IS186-OVb | 5'ATATCCACGCTTTCGCGAGTTCAG | ACTCGCGAAAGCGTGGATAT |

Hybridizations, washes and probe stripping procedures were carried out under standard conditions (Current Protocols in Molecular Biology (1994) sections 2.9-2.10). Each membrane was probed with a mixture of all six labeled probes and by each probe individually. Results are summarized in Table 6.

TABLE 6

Frequency of IS contamination in individual BAC library clones

| | Clone Name | Number of subclones | IS1 | IS2 | IS5 | IS10 | IS186 |
|---|---|---|---|---|---|---|---|
| 1 | C12_RP_4_V2(73)A1 | 369 | 1 | 14 | 1 | 11 | 0 |
| 2 | C22_RP_1_V2(107)A1 | 369 | 1 | 10 | 2 | 5 | 0 |
| 3 | CX_RP_3_V2(111)K1 | 377 | 2 | 5 | 0 | 13 | 10 |
| 4 | C12_RP_2_V2(71)A1 | 384 | 1 | 1 | 0 | 5 | 20 |
| 5 | C10_RP_3_V2(62)A1 | 384 | 1 | 11 | 4 | 11 | 0 |
| 6 | C2_RP_7_V2(15)A1 | 378 | 2 | 0 | 0 | 2 | 0 |
| 7 | C1_RP_5_V2(5)A1 | 378 | 0 | 0 | 0 | 2 | 0 |
| 8 | C22_RP_1_V2(107)K1 | 378 | 1 | 7 | 4 | 10 | 0 |
| 9 | C5_RP_3_V2(32)A1 | 384 | 3 | 10 | 1 | 1 | 0 |
| 10 | C5_RP_7_V2(36)A1 | 384 | 0 | 5 | 0 | 0 | 0 |
| 11 | C6_RP_5_V2(42)A1 | 377 | 17 | 2 | 0 | 1 | 0 |
| 12 | C5_RP_7_V2(36)I1 | 380 | 0 | 0 | 0 | 1 | 0 |
| 13 | C12_RP_4_V2(73)C1 | 368 | 0 | 2 | 0 | 3 | 0 |
| 14 | C5_RP_3_V2(32)I1 | 368 | 0 | 6 | 0 | 15 | 0 |
| 15 | CX_RP_3_V2(111)C1 | 367 | 0 | 6 | 1 | 11 | 23 |
| 16 | C4_RP_3_V2(26)I1 | 304 | 1 | 4 | 0 | 186 | 1 |
| 17 | C10_RP_3_V2(62)C1 | 379 | 0 | 0 | 0 | 0 | 0 |
| 18 | C2_RP_7_V2(15)C1 | 377 | 0 | 2 | 0 | 2 | 0 |
| 19 | C1_RP_5_V2(5)C1 | 380 | 2 | 10 | 2 | 5 | 33 |
| 20 | C4_RP_3_V2(26)C1 | 380 | 2 | 52 | 0 | 14 | 0 |
| 21 | C22_RP_1_V2(107)A1 | 375 | 0 | 12 | 0 | 1 | 6 |
| 22 | C12_RP_4_V2(73)I1 | 379 | 4 | 15 | 2 | 4 | 0 |
| 23 | Control a (1A5 in DH10B) | 384 | 0 | 0 | 0 | 0 | 0 |
| 24 | C9_RP_3_V2(57)C1 | 371 | 1 | 35 | 0 | 2 | 0 |
| 25 | C12_RP_4_V2(73)E1 | 383 | 10 | 31 | 0 | 14 | 3 |
| 26 | C22_RP1_1_V2(107)E1 | 379 | 1 | 10 | 1 | 27 | 0 |
| 27 | CX_RP_3_V2(111)E1 | 382 | 0 | 11 | 1 | 33 | 0 |
| 28 | C12_RP_2_V2(71)E1 | 384 | 1 | 6 | 0 | 6 | 0 |
| 29 | C10_RP_3_V2(62)E1 | 381 | 4 | 9 | 1 | 7 | 0 |
| 30 | C2_RP_7_V2(15)E1 | 383 | 0 | 11 | 0 | 5 | 0 |
| 31 | C1_RP_5_V2(5)E1 | 384 | 1 | 3 | 1 | 1 | 0 |
| 32 | C4_RP_3_V2(26)E1 | 382 | 2 | 14 | 1 | 8 | 0 |
| 33 | C5_RP_3_V2(32)E1 | 382 | 6 | 7 | 0 | 4 | 0 |
| 34 | C5_RP_7_V2(36)E1 | 351 | 4 | 4 | 6 | 14 | 0 |
| 35 | C6_RP_5_V2(42)E1 | 380 | 2 | 12 | 0 | 1 | 3 |
| 36 | C9_RP_3_V2(57)E1 | 381 | 6 | 15 | 5 | 16 | 5 |
| 37 | C12_RP_4_V2(73)G1 | 382 | 0 | 7 | 0 | 1 | 0 |
| 38 | Control b (1A5 in MDS42) | 382 | 0 | 0 | 0 | 0 | 0 |
| 39 | CX_RP_3_V2(111)G1 | 384 | 5 | 8 | 2 | 14 | 0 |
| 40 | C12_RP_2_V2(71)G1 | 384 | 3 | 6 | 1 | 9 | 0 |
| 41 | C10_RP_3_V2(62)G1 | 384 | 2 | 13 | 6 | 6 | 10 |
| 42 | C2_RP_7_V2(15)G1 | 382 | 1 | 29 | 0 | 4 | 17 |
| 43 | C1_RP_5_V2(5)G1 | 376 | 2 | 11 | 0 | 6 | 0 |
| 44 | C4_RP_3_V2(26)G1 | 379 | 2 | 379 | 3 | 29 | 4 |
| 45 | C5_RP_3_V2(32)G1 | 345 | 4 | 5 | 0 | 2 | 2 |
| 46 | C5_RP_7_V2(36)G1 | 374 | 1 | 20 | 4 | 0 | 1 |
| 47 | C6_RP_5_V2(42)G1 | 364 | 4 | 3 | 0 | 5 | 1 |
| 48 | Control c (1A5 in MDS42 + DH10B DNA) | 384 | 0 | 0 | 0 | 0 | 0 |

The lack of hybridization signal in any of the control hybridizations (clones 23, 38 and 48 in the table above) indicates that (a) DH 10B chromosomal DNA containing IS elements is not present in detectable quantities on the membranes, (b) no IS elements are present in DNA propagated solely in the IS-free strain MDS42recA and (c) no IS elements are transferred from DH10B chromosomal DNA to the BAC DNA in the course of the transformation procedure. The presence of IS elements in all but one (clone 17, BAC C10_RP__3_V2(62)C1) of the BACs isolated from DH10B, indicates that the hybridization strategy is an effective method for detecting IS elements on these membranes and that IS contamination is common in BACs propagated on strains containing IS elements. Together these data demonstrate that BAC libraries maintained in IS free bacterial hosts remain free of IS elements and therefore represent a superior technology for producing and maintaining BAC libraries.

In addition, IS free bacterial hosts can also be used to identify and isolate IS-free BACs from existing libraries by the transformation, arraying and probing strategy outlined in this example. For example, each of the 45 DH10B derived clones listed in Table 6 contains IS contaminated progeny as well as IS free progeny and the use of an IS free host, coupled with the hybridization screening strategy described here not only identifies, but also isolates, IS free clones from clones contaminated with IS elements. The resulting IS-free library would obviously be superior to the contaminated variant produced from IS containing bacteria.

EXAMPLE 8

Cloning of a Difficult to Clone Sequence in Strains Lacking IS Elements

Figure 5:
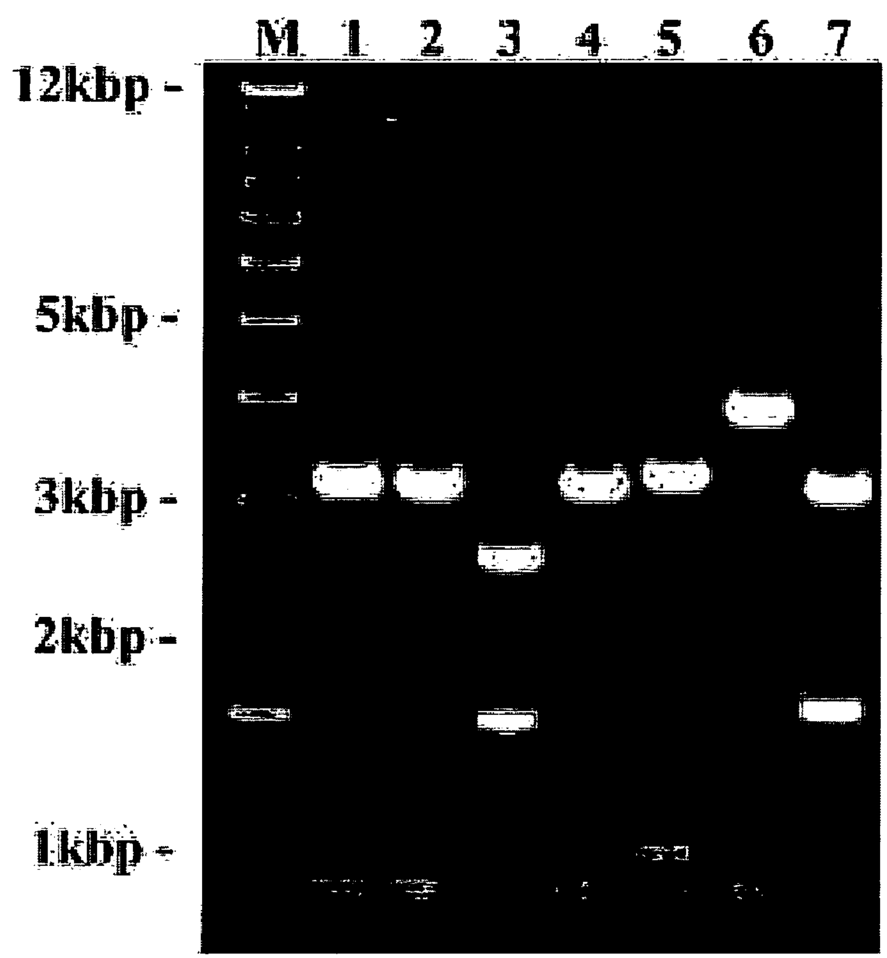
FIG. 5 shows the restriction pattern of pCTXVP60 propagated in various strains: (M) molecular weight marker, 1 kbp ladder; (1) MDS41, no insertion; (2) MDS42, no insertion; (3) DH10B, IS10 insertion; (4) DH10B, IS10 insertion/deletion; (5) C600, IS5 insertion; (6) C600 IS1 insertion; and (7) C600, IS1 insertion. Relative positions of the IS insertions in the CTXVP60 reading frame are diagrammed below the gel.
Figure 5:
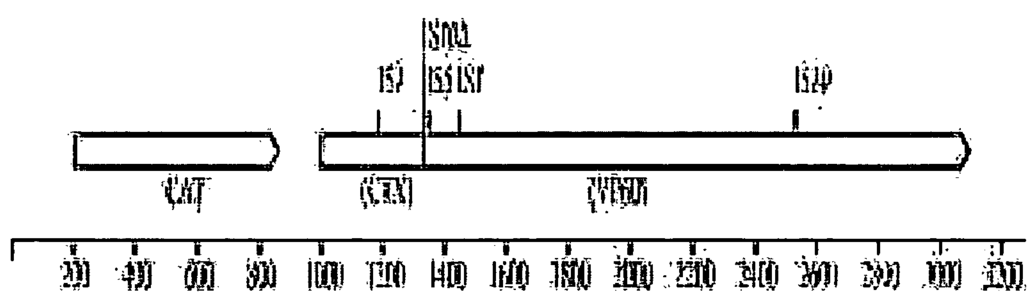

Attempts to clone the open reading frame encoding the VP60 of rabbit haemorrhagic disease virus fused to the B subunit of cholera toxin ("CTXVP60 fusion construct") using standard strains of bacteria have been unsuccessful. By providing a strain lacking IS elements, the CTXVP60 fusion construct was capable of being cloned. The surprising efficiency with which the CTXVP60 fusion construct was cloned in the strain lacking IS elements indicates that the presence of IS elements in the host chromosomal or extrachromosomal nucleic acids may be the primary obstacle to cloning such toxic genes. MDS42 was used to prepare pCTXVP60, carrying the CTXVP60 open reading frame. The plasmid DNA was then propagated in various hosts, isolated, then digested with NcoI and EcoRI. FIG. 5 shows a representative restriction pattern. The fragments were then purified and sequenced. MDS41 (lane 1) and MDS42 (lane 2) did not contain any insertion sequences. Plasmid DNA from DH10B contained an IS1 insertion (lane 3) and also an IS10 insertion/deletion (lane 4). Plasmid DNA from strain C600 contained an IS5 insertion (lane 5), and an IS1 insertion (lanes 6 and 7). This shows that strains lacking IS elements may be used to clone sequences that would be difficult to clone (e.g., toxic genes) in other strains.

EXAMPLE 9

Detection of IS Contamination of the Genome of a Host Carrying a Toxic Gene

Figure 6:
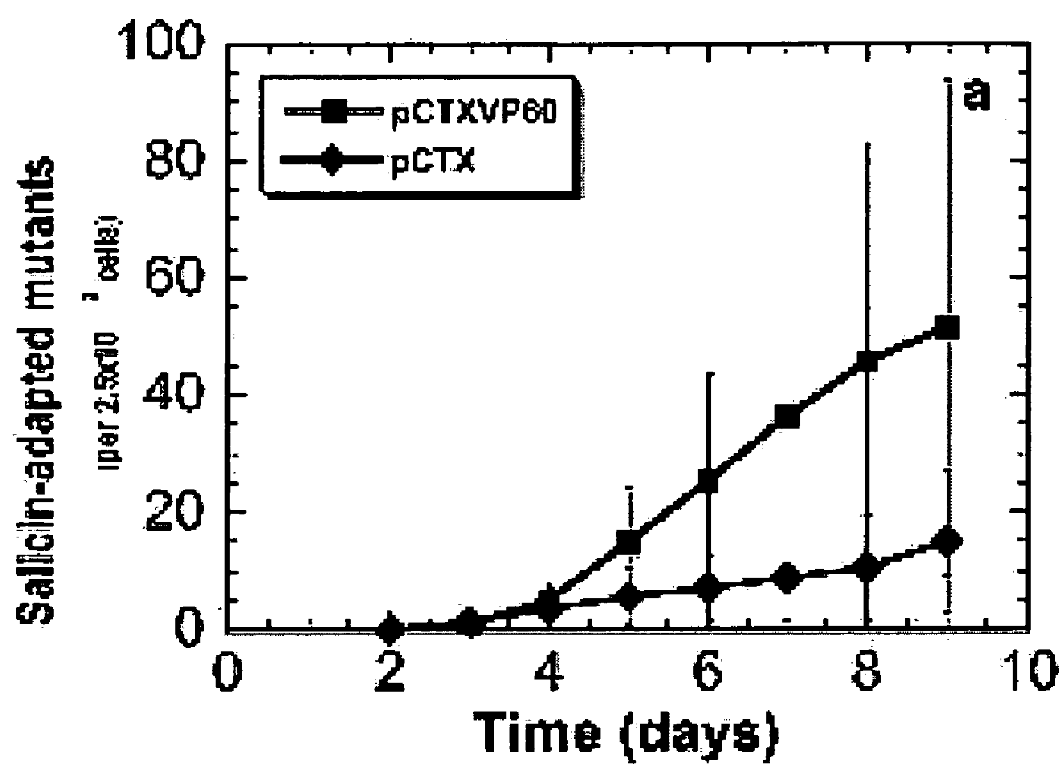
FIG. 6 compares the frequency of mutation by IS hopping to the genome in MG1655 transformed with either pCTXVP60 or pCTX as measured by the acquired ability to utilize salicin as a carbon source.

Bystander mutation tests were performed on MG1655 transformed with pCTXVP60. Briefly, MG1655 cells were electroporated with either pCTX, carrying the CTX open reading frame (MG1655(pCTX)), or the toxic construct pCTXVP60 (MG1655(pCTXVP60)) and the cultures were grown to saturation, followed by spreading on salicin/minimal plates. New colonies (adaptive mutants) were marked and counted daily. The data shown in FIG. 6 were derived from five replicate experiments. Total plated cell numbers were calculated by plating appropriate dilutions from 2-5 parallel cultures onto rich medium. The mean colony numbers were normalized to $2.5\times10^9$ cells. A two-factor ANOVA analysis ($\alpha\leqq0.05$) with post-hoc (t-tests) was used to determine if the adaptation rates (the mutant number/day) were significant with respect to strain or time. Both the time and strain/plasmid were determined to be significant ($p\leqq0.001$). The interaction of time and strain/plasmid was determined not to be significant. Counting the mutant colonies appearing on the plates revealed a>4-fold increase in the mutation rate due to pCTXVP60 (FIG. 6). Most of the bgl mutants of MG1655(pCTXVP60) also carry insertions in the plasmid.

EXAMPLE 10

Effect of Protein Overexpression on the Mutational Spectrum

Figure 7:
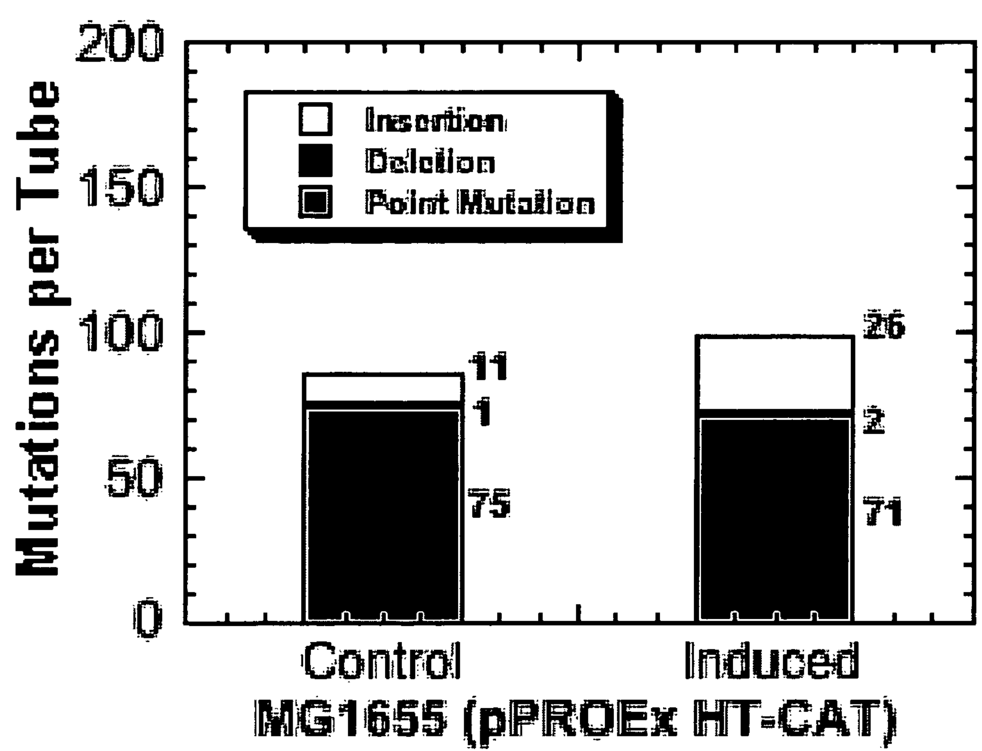
FIG. 7 compares the rate of IS hopping in MG1655 carrying an expression plasmid for CAT in the presence and absence of IPTG induction, as measured by the appearance of D-cycloserine mutants. D-cycloserine mutants result almost exclusively from loss-of-function mutations in cycA.

Cultures of MG1655 carrying an expression plasmid for the well tolerated CAT enzyme were compared with and without IPTG induction. Using fluctuation tests, a 2.5-fold increase in IS transposition rates into cycA in cultures derived from IPTG-treated cells was found. Insertions involving IS1, IS2, IS5 and IS150 were observed, while point mutation rates remained virtually unchanged. (FIG. 7). This indicates that the over-expression of recombinant proteins may induce IS transposition. The strains lacking IS elements may therefore be a more stable host for protein production.

EXAMPLE 11

Figure 8:
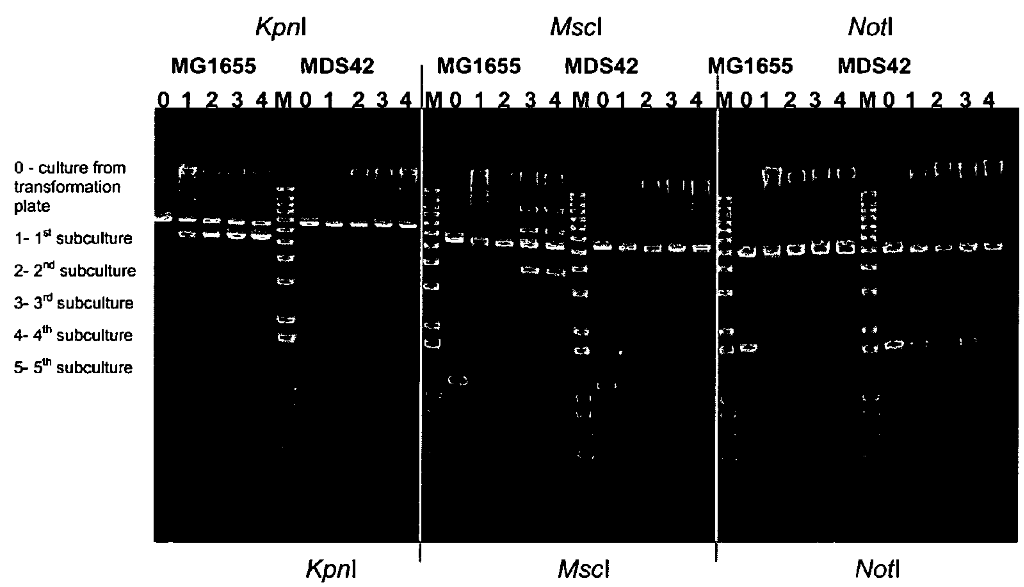
FIG. 8 shows the restriction pattern of pT-ITR propagated in MDS42 and MG1655.

Cloning of a Difficult to Clone Plasmid that Does Not Encode a Protein Product in a Strain Lacking IS Elements The plasmid pT-ITR, which contains a pair of G-C rich hairpins known as "hammerheads," which are thermodynamically very stable, was propagated for 4 serial passages with a $10^6$ dilution on each passage, in strains MDS42 and MG1655. FIG. 8 illustrates that 9T-ITR can be propagated intact for at least 4 serial passages in MDS42. However, 9T-ITR in the undeleted parent strain MG1655 is subject to deletion and rearrangement within the first passage.

TABLE 2

| Strain | Type | Coordinates | Name | B | Function |
|---|---|---|---|---|---|
| MDS01 | CDS | complement(262552 . . . 262893) | | b0245 | orf, hypothetical protein |
| MDS01 | CDS | complement(262914 . . . 263231) | yafW | b0246 | orf, hypothetical protein |
| MDS01 | CDS | complement(263480 . . . 263956) | ykfG | b0247 | putative DNA repair protein |
| MDS01 | CDS | complement(263972 . . . 264430) | yafX | b0248 | orf, hypothetical protein |
| MDS01 | CDS | complement(264528 . . . 264767) | ykfF | b0249 | orf, hypothetical protein |
| MDS01 | CDS | complement(264844 . . . 265311) | ykfB | b0250 | orf, hypothetical protein |
| MDS01 | CDS | complement(265334 . . . 266191) | yafY | b0251 | hypothetical transcriptional regulator |
| MDS01 | CDS | complement(266408 . . . 267244) | yafZ | b0252 | orf, hypothetical protein |
| MDS01 | CDS | complement(267321 . . . 268187) | ykfA | b0253 | putative GTP-binding protein |
| MDS01 | CDS | complement(268513 . . . 269406) | perR | b0254 | peroxide resistance protein |
| MDS01 | CDS | 269466 . . . 269870 | yi91a | b0255 | |
| MDS01 | CDS | 269827 . . . 270978 | tra8_1 | b0256 | IS30 transposase |
| MDS01 | CDS | 271054 . . . 271479 | | b0257 | putative transposase |
| MDS01 | CDS | 272086 . . . 273216 | ykfC | b0258 | orf, hypothetical protein |
| MDS01 | CDS | complement(273325 . . . 274341) | trs5_1 | b0259 | IS5 transposase |
| MDS01 | CDS | 274525 . . . 275952 | ykfB | b0260 | orf, hypothetical protein |
| MDS01 | CDS | 275939 . . . 276871 | yafY | b0261 | hypothetical transcriptional regulator |
| MDS01 | CDS | complement(276980 . . . 278038) | afuC | b0262 | putative ATP-binding component of a transport system |
| MDS01 | CDS | complement(278038 . . . 278400) | | b0263 | |
| MDS01 | CDS | complement(278402 . . . 278905) | insB_2 | b0264 | IS1 protein InsB |
| MDS01 | CDS | complement(278824 . . . 279099) | insA_2 | b0265 | IS1 protein InsA |
| MDS01 | CDS | complement(279609 . . . 279986) | yagB | b0266 | orf, hypothetical protein |
| MDS01 | CDS | complement(280053 . . . 281207) | yagA | b0267 | orf, hypothetical protein |
| MDS01 | CDS | 281481 . . . 282410 | yagE | b0268 | putative lyase/synthase |
| MDS01 | CDS | 282425 . . . 284392 | yagF | b0269 | putative dehydratase |
| MDS01 | CDS | 284619 . . . 286001 | yagG | b0270 | putative permease |
| MDS01 | CDS | 286013 . . . 287623 | yagH | b0271 | putative beta-xylosidase (EC 3.2.1.37 |
| MDS01 | CDS | complement(287628 . . . 288386) | yagI | b0272 | putative regulator |
| MDS01 | CDS | complement(288525 . . . 289529) | argF | b0273 | ornithine carbamoyltransferase 2, chain F |

TABLE 2-continued

| Strain | Type | Coordinates | Name | B | Function |
|---|---|---|---|---|---|
| MDS01 | CDS | complement(289873 . . . 290376) | insB_3 | b0274 | IS1 protein InsB |
| MDS01 | CDS | complement(290295 . . . 290570) | insA_3 | b0275 | IS1 protein InsA |
| MDS01 | CDS | 290724 . . . 291455 | yagJ | b0276 | orf, hypothetical protein |
| MDS01 | CDS | complement(291546 . . . 292172) | yagK | b0277 | orf, hypothetical protein |
| MDS01 | CDS | complement(292444 . . . 293142) | yagL | b0278 | DNA-binding protein |
| MDS01 | CDS | complement(293169 . . . 294023) | yagM | b0279 | orf, hypothetical protein |
| MDS01 | CDS | complement(294363 . . . 294803) | yagN | b0280 | orf, hypothetical protein |
| MDS01 | CDS | complement(294920 . . . 296320) | intF | b0281 | putative phage integrase |
| MDS01 | CDS | complement(296605 . . . 297015) | yagP | b0282 | putative transcriptional regulator LYSR-type |
| MDS01 | CDS | complement(296994 . . . 297950) | yagQ | b0283 | orf, hypothetical protein |
| MDS01 | CDS | complement(297960 . . . 300158) | yagR | b0284 | orf, hypothetical protein |
| MDS01 | CDS | complement(300155 . . . 301111) | yagS | b0285 | orf, hypothetical protein |
| MDS01 | CDS | complement(301108 . . . 301797) | yagT | b0286 | putative xanthine dehydrogenase (EC 1.1.1.20 |
| MDS01 | CDS | 302215 . . . 302829 | yagU | b0287 | orf, hypothetical protein |
| MDS01 | CDS | complement(303077 . . . 303406) | ykgJ | b0288 | putative ferredoxin |
| MDS01 | CDS | complement(303719 . . . 304474) | yagV | b0289 | orf, hypothetical protein |
| MDS01 | CDS | complement(304398 . . . 306041) | yagW | b0290 | putative receptor |
| MDS01 | CDS | complement(306031 . . . 308556) | yagX | b0291 | putative enzyme |
| MDS01 | CDS | complement(308582 . . . 309250) | yagY | b0292 | orf, hypothetical protein |
| MDS01 | CDS | complement(309308 . . . 309895) | yagZ | b0293 | orf, hypothetical protein |
| MDS01 | CDS | complement(309970 . . . 310560) | ykgK | b0294 | putative regulator |
| MDS01 | CDS | 311336 . . . 311563 | ykgL | b0295 | orf, hypothetical protein |
| MDS01 | CDS | complement(311738 . . . 312001) | ykgM | b0296 | putative ribosomal protein |
| MDS01 | CDS | 313581 . . . 314468 | eaeH | b0297 | attaching and effacing protein, pathogenesis factor |
| MDS01 | CDS | 314506 . . . 314814 | | b0298 | |
| MDS01 | CDS | 314811 . . . 315677 | tra5_5 | b0299 | |
| MDS01 | CDS | complement(315674 . . . 316393) | ykgA | b0300 | putative ARAC-type regulatory protein |
| MDS01 | CDS | complement(316950 . . . 317552) | ykgB | b0301 | orf, hypothetical protein |
| MDS01 | CDS | complement(317555 . . . 317806) | ykgI | b0303 | orf, hypothetical protein |
| MDS01 | CDS | complement(317900 . . . 319252) | ykgC | b0304 | putative oxidoreductase |
| MDS01 | CDS | 319451 . . . 320305 | ykgD | b0305 | putative ARAC-type regulatory protein |
| MDS01 | CDS | 320832 . . . 321551 | ykgE | b0306 | putative dehydrogenase subunit |
| MDS01 | CDS | 321562 . . . 322989 | ykgF | b0307 | orf, hypothetical protein |
| MDS01 | CDS | 322829 . . . 323677 | ykgG | b0308 | putative transporter |
| MDS01 | CDS | complement(323632 . . . 323844) | | b0309 | orf, hypothetical protein |
| MDS01 | CDS | complement(323920 . . . 324588) | ykgH | b0310 | orf, hypothetical protein |
| MDS02 | CDS | complement(1398271 . . . 1399803) | ydaH | b1336 | |
| MDS02 | CDS | complement(1399834 . . . 1401279) | | b1337 | |
| MDS02 | CDS | complement(1401279 . . . 1402604) | ydaJ | b1338 | |
| MDS02 | CDS | 1402765 . . . 1403673 | ydaK | b1339 | putative transcriptional regulator LYSR-type |
| MDS02 | CDS | 1404003 . . . 1404566 | ydaL | b1340 | orf, hypothetical protein |
| MDS02 | CDS | complement(1404587 . . . 1405879) | | b1341 | orf, hypothetical protein |
| MDS02 | CDS | 1406074 . . . 1407057 | | b1342 | orf, hypothetical protein |
| MDS02 | CDS | 1407535 . . . 1408908 | dbpA | b1343 | ATP-dependent RNA helicase |
| MDS02 | CDS | complement(1409037 . . . 1409972) | ydaO | b1344 | orf, hypothetical protein |
| MDS02 | CDS | complement(1410024 . . . 1411259) | | b1345 | |
| MDS02 | CDS | complement(1411261 . . . 1411500) | ydaQ | b1346 | putative lambdoid prophage Rac excisionase |
| MDS02 | CDS | complement(1411555 . . . 1411764) | ydaC | b1347 | orf, hypothetical protein |
| MDS02 | CDS | complement(1411757 . . . 1411951) | lar | b1348 | restriction alleviation and modification enhancement |
| MDS02 | CDS | complement(1412008 . . . 1412817) | recT | b1349 | recombinase, DNA renaturation |
| MDS02 | CDS | complement(1412810 . . . 1415410) | recE | b1350 | exonuclease VIII, ds DNA exonuclease 5'--> 3' specific |
| MDS02 | CDS | complement(1415512 . . . 1415787) | racC | b1351 | RacC protein |
| MDS02 | CDS | complement(1416032 . . . 1416265) | kil | b1352 | Kil protein (killing function) of lambdoid prophage Rac |
| MDS02 | CDS | 1416572 . . . 1417183 | sieB | b1353 | phage superinfection exclusion protein |
| MDS02 | CDS | 1417192 . . . 1417368 | | b1354 | orf, hypothetical protein |
| MDS02 | CDS | complement(1417346 . . . 1417525) | | b1355 | orf, hypothetical protein |
| MDS02 | CDS | complement(1417789 . . . 1418265) | ydaR | b1356 | |
| MDS02 | CDS | 1418389 . . . 1418685 | ydaS | b1357 | orf, hypothetical protein |
| MDS02 | CDS | 1418708 . . . 1419130 | ydaT | b1358 | orf, hypothetical protein |
| MDS02 | CDS | 1419143 . . . 1420000 | ydaU | b1359 | orf, hypothetical protein |
| MDS02 | CDS | 1420007 . . . 1420753 | | b1360 | putative DNA replication factor |
| MDS02 | CDS | 1420725 . . . 1421336 | ydaW | b1361 | orf, hypothetical protein |
| MDS02 | CDS | 1421363 . . . 1421668 | | b1362 | putative Rac prophage endopeptidase |
| MDS02 | CDS | 1421806.1423263 | trkG | b1363 | |
| MDS02 | CDS | 1423202 . . . 1423483 | | b1364 | orf, hypothetical protein |
| MDS02 | CDS | 1423401 . . . 1423664 | | b1365 | orf, hypothetical protein |
| MDS02 | CDS | 1423645 . . . 1424004 | ydaY | b1366 | orf, hypothetical protein |
| MDS02 | CDS | 1424079 . . . 1424312 | | b1367 | orf, hypothetical protein |
| MDS02 | CDS | 1424478 . . . 1425506 | | b1368 | putative alpha helix protein |
| MDS02 | CDS | 1425482 . . . 1425637 | | b1369 | orf, hypothetical protein |
| MDS02 | CDS | complement(1425770 . . . 1426750) | trs5_5 | b1370 | |
| MDS02 | CDS | 1426547 . . . 1427008 | | b1371 | orf, hypothetical protein |

TABLE 2-continued

| Strain | Type | Coordinates | Name | B | Function |
|---|---|---|---|---|---|
| MDS02 | CDS | 1427067 . . . 1430435 | | b1372 | |
| MDS02 | CDS | 1430435 . . . 1431010 | | b1373 | tail fiber assembly protein homolog from lambdoid prophage Rac |
| MDS02 | CDS | complement(1431108 . . . 1431698) | | b1374 | |
| MDS02 | CDS | complement(1432015 . . . 1432281) | ynaE | b1375 | orf, hypothetical protein |
| MDS02 | CDS | complement(1433209 . . . 1433715) | | b1376 | ynaF putative filament protein |
| MDS02 | CDS | complement(1433784 . . . 1434917) | | b1377 | |
| MDS02 | CDS | complement(1435284 . . . 1438808) | ydbK | b1378 | putative oxidoreductase, Fe—S subunit |
| MDS02 | CDS | complement(1439345 . . . 1439767) | hslJ | b1379 | heat shock protein HslJ |
| MDS02 | CDS | complement(1439878 . . . 1440867) | ldhA | b1380 | fermentative D-lactate dehydrogenase NAD-dependent |
| MDS02 | CDS | 1441075 . . . 1443714 | ydbH | b1381 | orf, hypothetical protein |
| MDS02 | CDS | 1443711 . . . 1443896 | ynbE | b1382 | orf, hypothetical protein |
| MDS02 | CDS | 1443898 . . . 1444230 | ydbL | b1383 | orf, hypothetical protein |
| MDS02 | CDS | complement(1444402 . . . 1445307) | feaR | b1384 | regulatory protein for 2-phenylethylamine catabolism |
| MDS02 | CDS | 1445540 . . . 1447042 | feaB | b1385 | phenylacetaldehyde dehydrogenase |
| MDS02 | CDS | complement(1447100 . . . 1449373) | tynA | b1386 | copper amine oxidase (tyramine oxidase) |
| MDS02 | CDS | complement(1449621 . . . 1451666) | maoC | b1387 | |
| MDS02 | CDS | 1451951 . . . 1452880 | ydbO | b1388 | |
| MDS02 | CDS | 1452892 . . . 1453179 | ynbF | b1389 | |
| MDS02 | CDS | 1453188 . . . 1453934 | ydbP | b1390 | |
| MDS02 | CDS | 1453943 . . . 1454446 | | b1391 | |
| MDS02 | CDS | 1454454 . . . 1455524 | | b1392 | |
| MDS02 | CDS | 1455521 . . . 1456288 | ydbS | b1393 | |
| MDS02 | CDS | 1456288 . . . 1457076 | | b1394 | |
| MDS02 | CDS | 1457078 . . . 1458505 | ydbU | b1395 | |
| MDS02 | CDS | 1458495 . . . 1458917 | | b1396 | |
| MDS02 | CDS | 1458917 . . . 1460122 | | b1397 | |
| MDS02 | CDS | 1460149 . . . 1461462 | | b1398 | |
| MDS02 | CDS | 1461563 . . . 1462513 | | b1399 | |
| MDS02 | CDS | 1462495 . . . 1463085 | | b1400 | |
| MDS02 | CDS | 1463416 . . . 1465974 | ydbA_1 | b1401 | |
| MDS02 | CDS | complement(1465945 . . . 1466850) | yi22_2 | b1402 | IS2 hypothetical protein |
| MDS02 | CDS | complement(1466808 . . . 1467218) | yi21_2 | b1403 | IS2 hypothetical protein |
| MDS02 | CDS | 1467382 . . . 1468533 | tra8_2 | b1404 | IS30 transposase |
| MDS02 | CDS | 1468714 . . . 1472037 | ydbA_2 | b1405 | |
| MDS02 | CDS | 1472245 . . . 1473105 | ydbC | b1406 | putative dehydrogenase |
| MDS02 | CDS | 1473162 . . . 1475474 | ydbD | b1407 | orf, hypothetical protein |
| MDS02 | CDS | 1475639 . . . 1476250 | | b1408 | |
| MDS02 | CDS | 1476250 . . . 1477146 | | b1409 | putative phosphatidate cytidiltransferase |
| MDS02 | CDS | 1477162 . . . 1478919 | | b1410 | orf, hypothetical protein |
| MDS02 | CDS | 1478933 . . . 1480225 | ynbD | b1411 | putative enzymes |
| MDS02 | misc_RNA | complement(1403676 . . . 1403833) | IS061 | b4426 | |
| MDS02 | misc_RNA | 1435145 . . . 1435252 | tke8 | b4427 | |
| MDS03 | CDS | complement(2555340 . . . 2556743) | eutB | b2441 | ethanolamine ammonia-lyase, heavy chain |
| MDS03 | CDS | 2556793 . . . 2558088 | | b2442 | putative prophage integrase |
| MDS03 | CDS | 2558279 . . . 2558920 | | b2443 | orf, hypothetical protein |
| MDS03 | CDS | 2559390 . . . 2559635 | | b2444 | orf, hypothetical protein |
| MDS03 | CDS | 2559632 . . . 2560015 | | b2445 | orf, hypothetical protein |
| MDS03 | CDS | 2560133 . . . 2560549 | | b2446 | orf, hypothetical protein |
| MDS03 | CDS | 2560546 . . . 2561139 | | b2447 | orf, hypothetical protein |
| MDS03 | CDS | 2561599 . . . 2561991 | | b2448 | orf, hypothetical protein |
| MDS03 | CDS | 2562002 . . . 2562394 | | b2449 | orf, hypothetical protein |
| MDS03 | CDS | 2562515 . . . 2563354 | | b2450 | orf, hypothetical protein |
| MDS04 | CDS | 2754181 . . . 2755422 | intA | b2622 | prophage CP4-57 integrase |
| MDS04 | CDS | complement(2755666 . . . 2756622) | yfjH | b2623 | putative histone |
| MDS04 | CDS | 2756666 . . . 2756878 | alpA | b2624 | prophage CP4-57 regulatory protein alpA |
| MDS04 | CDS | 2757007 . . . 2758416 | yfjI | b2625 | orf, hypothetical protein |
| MDS04 | CDS | 2758569 . . . 2759195 | yfjJ | b2626 | orf, hypothetical protein |
| MDS04 | CDS | complement(2759373 . . . 2761562) | yfjK | b2627 | orf, hypothetical protein |
| MDS04 | CDS | complement(2761559 . . . 2763175) | yfjL | b2628 | orf, hypothetical protein |
| MDS04 | CDS | complement(2763535 . . . 2763798) | yfjM | b2629 | orf, hypothetical protein |
| MDS04 | CDS | 2763940 . . . 2765013 | yfjN | b2630 | putative cell division protein |
| MDS04 | CDS | 2765057 . . . 2765377 | yfjO | b2631 | orf, hypothetical protein |
| MDS04 | CDS | 2765732 . . . 2766595 | yfjP | b2632 | putative GTP-binding protein |
| MDS04 | CDS | 2766687 . . . 2767508 | yfjQ | b2633 | orf, hypothetical protein |
| MDS04 | CDS | 2767725 . . . 2768426 | yfjR | b2634 | orf, hypothetical protein |
| MDS04 | CDS | 2768311 . . . 2768703 | | b2635 | orf, hypothetical protein |
| MDS04 | CDS | 2768454 . . . 2769146 | | b2636 | orf, hypothetical protein |
| MDS04 | CDS | 2769170 . . . 2769637 | yfjT | b2637 | orf, hypothetical protein |
| MDS04 | CDS | complement(2769862 . . . 2770176) | | b2638 | orf, hypothetical protein |
| MDS04 | CDS | complement(2770189 . . . 2770707) | | b2639 | putative pump protein |
| MDS04 | CDS | complement(2770858 . . . 2771058) | | b2640 | orf, hypothetical protein |
| MDS04 | CDS | complement(2770998 . . . 2771114) | | b2641 | orf, hypothetical protein |
| MDS04 | CDS | 2771340 . . . 2773043 | yfjW | b2642 | orf, hypothetical protein |
| MDS04 | CDS | 2773941 . . . 2774399 | yfjX | b2643 | orf, hypothetical protein |
| MDS04 | CDS | 2774408 . . . 2774890 | yfjY | b2644 | putative DNA repair protein |

TABLE 2-continued

| Strain | Type | Coordinates | Name | B | Function |
|---|---|---|---|---|---|
| MDS04 | CDS | 2775137 . . . 2775454 | yfjZ | b2645 | orf, hypothetical protein |
| MDS04 | CDS | 2775475 . . . 2775804 | ypjF | b2646 | orf, hypothetical protein |
| MDS04 | CDS | complement(2776168 . . . 2780877) | ypjA | b2647 | putative ATP-binding component of a transport system |
| MDS04 | CDS | complement(2781087 . . . 2781230) | | b2648 | orf, hypothetical protein |
| MDS04 | CDS | complement(2781660 . . . 2782451) | | b2649 | orf, hypothetical protein |
| MDS04 | CDS | complement(2782551 . . . 2783033) | | b2650 | orf, hypothetical protein |
| MDS04 | CDS | 2783243 . . . 2783374 | | b2651 | orf, hypothetical protein |
| MDS04 | tRNA | complement(2783784 . . . 2783859) | ileY | b2652 | tRNA-Ile |
| MDS04 | CDS | complement(2783822 . . . 2783995) | | b2653 | orf, hypothetical protein |
| MDS04 | CDS | 2784419 . . . 2784751 | | b2654 | orf, hypothetical protein |
| MDS04 | CDS | 2785628 . . . 2786260 | | b2657 | putative enzyme |
| MDS04 | CDS | 2786399 . . . 2786671 | | b2658 | orf, hypothetical protein |
| MDS04 | CDS | 2786902 . . . 2787984 | | b2659 | orf, hypothetical protein |
| MDS04 | CDS | 2787938 . . . 2789272 | ygaF | b2660 | orf, hypothetical protein |
| MDS04 | CDS | 2784770 . . . 2785456 | ygaR | b4462 | orf, hypothetical protein |
| MDS05 | CDS | complement(2064329 . . . 2065345) | trs5_6 | b1994 | IS5 transposase |
| MDS05 | CDS | 2066632 . . . 2067051 | | b1995 | orf, hypothetical protein |
| MDS05 | CDS | complement(2066976 . . . 2067881) | yi22_3 | b1996 | IS2 hypothetical protein |
| MDS05 | CDS | complement(2067839 . . . 2068249) | yi21_3 | b1997 | IS2 hypothetical protein |
| MDS05 | CDS | 2068268 . . . 2068528 | | b1998 | orf, hypothetical protein |
| MDS05 | CDS | 2068525 . . . 2069235 | yeeP | b1999 | putative histone |
| MDS05 | CDS | 2069563 . . . 2072682 | flu | b2000 | antigen 43, phase-variable bipartite outer membrane fluffing protein |
| MDS05 | CDS | 2072797 . . . 2074335 | | b2001 | orf, hypothetical protein |
| MDS05 | CDS | 2074332 . . . 2074778 | yeeS | b2002 | putative DNA repair protein, RADC family |
| MDS05 | CDS | 2074841 . . . 2075062 | yeeT | b2003 | orf, hypothetical protein |
| MDS05 | CDS | 2075136 . . . 2075504 | yeeU | b2004 | putative structural protein |
| MDS05 | CDS | 2075593 . . . 2075967 | yeeV | b2005 | orf, hypothetical protein |
| MDS05 | CDS | 2075964 . . . 2076158 | yeeW | b2006 | orf, hypothetical protein |
| MDS05 | CDS | complement(2077056 . . . 2077451) | veeX | b2007 | putative alpha helix protein |
| MDS05 | CDS | complement(2077557 . . . 2078615) | yeeA | b2008 | orf, hypothetical protein |
| MDS05 | misc_RNA | 2069339 . . . 2069542 | | b4435 | IS102 |
| MDS06 | CDS | complement(3451530 . . . 3451949) | | b3322 | calcium-binding protein required for initiation of chromosome replication |
| MDS06 | CDS | complement(3451951 . . . 3453420) | yheD | b3323 | putative export protein A for general secretion pathway (GSP) |
| MDS06 | CDS | 3453600 . . . 3454415 | yheE | b3324 | |
| MDS06 | CDS | 3454387 . . . 3456351 | yheF | b3325 | |
| MDS06 | CDS | 3456361 . . . 3457842 | yheG | b3326 | |
| MDS06 | CDS | 3457839 . . . 3459035 | hofF | b3327 | |
| MDS06 | CDS | 3459045 . . . 3459482 | hofG | b3328 | |
| MDS06 | CDS | 3459490 . . . 3459999 | hofH | b3329 | |
| MDS06 | CDS | 3459957 . . . 3460373 | yheH | b3330 | |
| MDS06 | CDS | 3460366 . . . 3460953 | yheI | b3331 | |
| MDS06 | CDS | 3460946 . . . 3461929 | yheJ | b3332 | |
| MDS06 | CDS | 3461941 . . . 3463107 | yheK | b3333 | |
| MDS06 | CDS | 3463080 . . . 3463565 | pshM | b3334 | |
| MDS06 | CDS | 3463565 . . . 3464242 | hofD | b3335 | |
| MDS06 | CDS | complement(3464271 . . . 3464747) | bfr | b3336 | bacterioferrin, an iron storage homoprotein |
| MDS06 | CDS | complement(3464819 . . . 3465013) | yheA | b3337 | |
| MDS06 | CDS | complement(3465182 . . . 3467875) | yheB | b3338 | |
| MDS07 | CDS | 2464567 . . . 2465724 | intC | b2349 | |
| MDS07 | CDS | 2465877 . . . 2466239 | | b2350 | |
| MDS07 | CDS | 2471542 . . . 2471988 | | b2350 | orf, hypothetical protein |
| MDS07 | CDS | 2466236 . . . 2467156 | | b2351 | |
| MDS07 | CDS | 2467153 . . . 2468484 | | b2352 | putative ligase |
| MDS07 | CDS | 2468783 . . . 2469127 | | b2353 | |
| MDS07 | CDS | complement(2469099 . . . 2469539) | | b2354 | orf, hypothetical protein |
| MDS07 | CDS | complement(2469566 . . . 2470084) | yfdL | b2355 | putative RNA polymerase beta |
| MDS07 | CDS | complement(2470134 . . . 2470442) | yfdM | b2356 | orf, hypothetical protein |
| MDS07 | CDS | complement(2470409 . . . 2470903) | yfdN | b2357 | orf, hypothetical protein |
| MDS07 | CDS | complement(2470900 . . . 2471268) | yfdO | b2358 | orf, hypothetical protein |
| MDS07 | CDS | 2472054 . . . 2472878 | | b2360 | orf, hypothetical protein |
| MDS07 | CDS | 2472979 . . . 2473542 | | b2361 | orf, hypothetical protein |
| MDS07 | CDS | 2473533 . . . 2473895 | | b2362 | orf, hypothetical protein |
| MDS07 | CDS | 2473895 . . . 2474200 | | b2363 | orf, hypothetical protein |
| MDS08 | CDS | 1625541 . . . 1626287 | ydfG | b1539 | putative oxidoreductase |
| MDS08 | CDS | 1626376 . . . 1627062 | ydfH | b1540 | orf, hypothetical protein |
| MDS08 | CDS | 1627239 . . . 1627442 | | b1541 | orf, hypothetical protein |
| MDS08 | CDS | complement(1627477 . . . 1628937) | ydfI | b1542 | putative oxidoreductase |
| MDS08 | CDS | complement(1629026 . . . 1630309) | | b1543 | putative transport protein |
| MDS08 | CDS | 1631063 . . . 1631329 | ydfK | b1544 | orf, hypothetical protein |
| MDS08 | CDS | 1631646 . . . 1632236 | | b1545 | |
| MDS08 | CDS | complement(1632334 . . . 1632909) | ydfM | b1546 | tail fiber assembly protein homolog from lambdoid prophage Qin |
| MDS08 | CDS | complement(1632909 . . . 1633871) | | b1547 | |

TABLE 2-continued

| Strain | Type | Coordinates | Name | B | Function |
|---|---|---|---|---|---|
| MDS08 | CDS | complement(1633822 . . . 1634391) | nohA | b1548 | DNA packaging protein NU1 homolog from lambdoid prophages |
| MDS08 | CDS | 1635056 . . . 1635481 | ydfO | b1549 | orf, hypothetical protein |
| MDS08 | CDS | complement(1635633 . . . 1635809) | | b1550 | |
| MDS08 | CDS | complement(1635978 . . . 1636169) | | b1551 | orf, hypothetical protein |
| MDS08 | CDS | complement(1636479 . . . 1636691) | cspI | b1552 | cold shock-like protein |
| MDS08 | CDS | complement(1637054 . . . 1637551) | | b1553 | orf, hypothetical protein |
| MDS08 | CDS | complement(1637548 . . . 1638081) | | b1554 | |
| MDS08 | CDS | complement(1638078 . . . 1638389) | | b1555 | orf, hypothetical protein |
| MDS08 | CDS | complement(1638394 . . . 1638684) | | b1556 | |
| MDS08 | CDS | complement(1639363 . . . 1639578) | cspB | b1557 | |
| MDS08 | CDS | 1639879 . . . 1640091 | cspF | b1558 | |
| MDS08 | CDS | complement(1640513 . . . 1641295) | | b1559 | |
| MDS08 | CDS | complement(1641279 . . . 1642367) | | b1560 | orf, hypothetical protein |
| MDS08 | CDS | complement(1642675 . . . 1642926) | rem | b1561 | orf, hypothetical protein |
| MDS08 | CDS | complement(1643143 . . . 1643298) | hokD | b1562 | polypeptide destructive to membrane potential |
| MDS08 | CDS | complement(1643370 . . . 1643657) | relE | b1563 | orf, hypothetical protein |
| MDS08 | CDS | complement(1643657 . . . 1643896) | relB | b1564 | negative regulator of translation |
| MDS08 | CDS | 1643921 . . . 1644226 | | b1565 | orf, hypothetical protein |
| MDS08 | CDS | 1644429 . . . 1644761 | flxA | b1566 | orf, hypothetical protein |
| MDS08 | CDS | complement(1645198 . . . 1645347) | | b1567 | orf, hypothetical protein |
| MDS08 | CDS | complement(1645370 . . . 1645660) | | b1568 | orf, hypothetical protein |
| MDS08 | CDS | complement(1645644 . . . 1645874) | dicC | b1569 | regulator of dicB |
| MDS08 | CDS | 1645958 . . . 1646365 | dicA | b1570 | regulator of dicB |
| MDS08 | CDS | 1646532 . . . 1646687 | ydfA | b1571 | orf, hypothetical protein |
| MDS08 | CDS | 1646647 . . . 1646817 | ydfB | b1572 | orf, hypothetical protein |
| MDS08 | CDS | 1646847 . . . 1647065 | ydfC | b1573 | orf, hypothetical protein |
| MDS08 | misc_RNA | 1647406 . . . 1647458 | dicF | b1574 | DicF antisense RNA, inhibits ftsZ translation |
| MDS08 | CDS | 1647633 . . . 1647821 | dicB | b1575 | inhibition of cell division |
| MDS08 | CDS | 1647818 . . . 1648009 | ydfD | b1576 | orf, hypothetical protein |
| MDS08 | CDS | 1648102 . . . 1649022 | ydfE | b1577 | orf, hypothetical protein |
| MDS08 | CDS | 1648905 . . . 1649561 | | b1578 | orf, hypothetical protein |
| MDS08 | CDS | 1649536 . . . 1650732 | | b1579 | |
| MDS09 | CDS | complement(4493213 . . . 4494274) | yjgB | b4269 | putative oxidoreductase |
| MDS09 | tRNA | 4494428 . . . 4494512 | leuX | b4270 | tRNA-Leu |
| MDS09 | CDS | 4494773 . . . 4495963 | intB | b4271 | prophage P4 integrase |
| MDS09 | CDS | 4496250 . . . 4496660 | yi21_6 | b4272 | IS2 hypothetical protein |
| MDS09 | CDS | 4496618 . . . 4497523 | yi22_6 | b4273 | IS2 hypothetical protein |
| MDS09 | CDS | 4497622 . . . 4497957 | yjgW | b4274 | orf, hypothetical protein |
| MDS09 | CDS | complement(4498066 . . . 4498512) | yjgX | b4275 | orf, hypothetical protein |
| MDS09 | CDS | complement(4498455 . . . 4498904) | yjgY | b4276 | orf, hypothetical protein |
| MDS09 | CDS | 4499283 . . . 4499612 | yjgZ | b4277 | orf, hypothetical protein |
| MDS09 | CDS | complement(4500126 . . . 4501454) | yi41 | b4278 | IS4 hypothetical protein |
| MDS09 | CDS | 4502021 . . . 4503298 | yjhB | b4279 | putative transport protein |
| MDS09 | CDS | 4503295 . . . 4504428 | yjhC | b4280 | putative dehydrogenase |
| MDS09 | CDS | complement(4504649 . . . 4505023) | yjhD | b4281 | orf, hypothetical protein |
| MDS09 | CDS | 4504929 . . . 4505132 | yjhE | b4282 | orf, hypothetical protein |
| MDS09 | CDS | 4505184 . . . 4505486 | yi91b | b4283 | |
| MDS09 | CDS | complement(4505489 . . . 4506640) | tra8_3 | b4284 | IS30 transposase |
| MDS09 | CDS | 4506981 . . . 4507577 | | b4285 | putative transposase |
| MDS09 | CDS | 4507743 . . . 4508156 | | b4286 | orf, hypothetical protein |
| MDS09 | CDS | complement(4508713 . . . 4509480) | fecE | b4287 | ATP-binding component of citrate-dependent |
| MDS09 | CDS | complement(4509481 . . . 4510437) | fecD | b4288 | citrate-dependent iron transport, membrane-bound protein |
| MDS09 | CDS | complement(4510434 . . . 4511432) | fecC | b4289 | citrate-dependent iron(III) transport protein, cytosolic |
| MDS09 | CDS | complement(4511429 . . . 4512337) | fecB | b4290 | citrate-dependent iron transport, periplasmic protein |
| MDS09 | CDS | complement(4512376 . . . 4514700) | fecA | b4291 | outer membrane receptor; citrate-dependent iron |
| MDS09 | CDS | complement(4514787 . . . 4515740) | fecR | b4292 | outer membrane receptor; citrate-dependent iron transport, outer membrane receptor |
| MDS09 | CDS | complement(4515737 . . . 4516258) | fecI | b4293 | probable RNA polymerase sigma factor |
| MDS09 | CDS | 4516550 . . . 4516825 | insA_7 | b4294 | IS1 protein InsA |
| MDS09 | CDS | complement(4517361 . . . 4518161) | yjhU | b4295 | orf, hypothetical protein |
| MDS09 | CDS | complement(4518694 . . . 4520043) | yihF | b4296 | putative transport system permease |
| MDS09 | CDS | complement(4520150 . . . 4522117) | yjhG | b4297 | putative dehydratase |
| MDS09 | CDS | complement(4522128 . . . 4523087) | yjhH | b4298 | putative lyase/synthase |
| MDS09 | CDS | complement(4523038 . . . 4523826) | yjhI | b4299 | putative regulator |
| MDS09 | CDS | complement(4524129 . . . 4524911) | sgcR | b4300 | putative DEOR-type transcriptional regulator |
| MDS09 | CDS | complement(4524928 . . . 4525560) | sgcE | b4301 | putative epimerase |
| MDS09 | CDS | complement(4525572 . . . 4526003) | sgcA | b4302 | putative PTS system enzyme II A component |

TABLE 2-continued

| Strain | Type | Coordinates | Name | B | Function |
|---|---|---|---|---|---|
| MDS09 | CDS | complement(4526134 . . . 4526940) | sgcQ | b4303 | putative nucleoside triphosphatase |
| MDS09 | CDS | complement(4526953 . . . 4528266) | sgcC | b4304 | putative PTS system enzyme IIC component |
| MDS09 | CDS | complement(4528553 . . . 4529704) | sgcX | b4305 | putative lyase/synthase |
| MDS09 | CDS | complement(4530460 . . . 4531206) | yjhP | b4306 | putative methyltransferase |
| MDS09 | CDS | complement(4531262 . . . 4531807) | yjhQ | b4307 | orf, hypothetical protein |
| MDS09 | CDS | 4533038 . . . 4534054 | yjhR | b4308 | putative frameshift suppressor" |
| MDS09 | CDS | complement(4534637 . . . 4535617) | yjhS | b4309 | orf, hypothetical protein |
| MDS09 | CDS | complement(4535682 . . . 4536896) | yjhT | b4310 | orf, hypothetical protein |
| MDS09 | CDS | complement(4536808 . . . 4537533) | yjhA | b4311 | orf, hypothetical protein |
| MDS09 | CDS | 4538980 . . . 4539582 | fimB | b4312 | recombinase involved in phase variation; regulator for fimA" |
| MDS09 | CDS | 4540060 . . . 4540656 | fimE | b4313 | recombinase involved in phase variation; regulator for fimA" |
| MDS09 | CDS | 4541138 . . . 4541686 | fimA | b4314 | major type 1 subunit fimbrin (pilin) |
| MDS09 | CDS | 4541643 . . . 4542290 | fimI | b4315 | fimbrial protein |
| MDS09 | CDS | 4542327 . . . 4543052 | fimC | b4316 | periplasmic chaperone, required for type 1 fimbriae |
| MDS09 | CDS | 4543119 . . . 4545755 | fimD | b4317 | outer membrane protein; export and assembly of type 1 fimbriae, interrupted |
| MDS09 | CDS | 4545765 . . . 4546295 | fimF | b4318 | fimbrial morphology |
| MDS09 | CDS | 4546308 . . . 4546811 | fimG | b4319 | fimbrial morphology |
| MDS09 | CDS | 4546831 . . . 4547733 | fimH | b4320 | minor fimbrial subunit, D-mannose specific adhesin |
| MDS10 | CDS | complement(3108612 . . . 3109148) | yghD | b2968 | putative secretion pathway protein |
| MDS10 | CDS | complement(3109150 . . . 3110010) | yghE | b2969 | putative general secretion pathway for protein export (GSP) |
| MDS10 | CDS | complement(3110076 . . . 3110942) | | b2970 | putative general secretion pathway for protein export (GSP) |
| MDS10 | CDS | complement(3111089 . . . 3111499) | | b2971 | orf, hypothetical protein |
| MDS10 | CDS | complement(3111565 . . . 3112497) | | b2972 | |
| MDS10 | CDS | complement(3117619 . . . 3119301) | yghK | b2975 | putative permease |
| MDS10 | CDS | complement(3119656 . . . 3121827) | glcB | b2976 | malate synthase G |
| MDS10 | CDS | complement(3121849 . . . 3122253) | glcG | b2977 | orf, hypothetical protein |
| MDS10 | CDS | complement(3124544 . . . 3126043) | glcD | b2979 | glycolate oxidase subunit D |
| MDS10 | CDS | 3126294 . . . 3127058 | glcC | b2980 | transcriptional activator for glc operon |
| MDS10 | CDS | complement(3127065 . . . 3128237) | | b2981 | orf, hypothetical protein |
| MDS10 | CDS | 3128200 . . . 3129216 | trs5_9 | b2982 | IS5 transposase |
| MDS10 | CDS | complement(3129363 . . . 3130430) | yghQ | b2983 | orf, hypothetical protein |
| MDS10 | CDS | complement(3130476 . . . 3131234) | yghR | b2984 | orf, hypothetical protein |
| MDS10 | CDS | complement(3131266 . . . 3131979) | yghS | b2985 | orf, hypothetical protein |
| MDS10 | CDS | 3132153 . . . 3132845 | yghT | b2986 | orf, hypothetical protein |
| MDS10 | CDS | complement(3132894 . . . 3134393) | pitB | b2987 | low-affinity phosphate transport |
| MDS10 | CDS | complement(3112572 . . . 3117134) | yghJ | b4466 | putative lipoprotein |
| MDS10 | CDS | complement(3122258 . . . 3123481) | glcF | b4467 | glycolate oxidase iron-sulfur subunit |
| MDS10 | CDS | complement(3123492 . . . 3124544) | glcE | b4468 | glycolate oxidase iron-sulfur subunit |
| MDS11 | CDS | complement(1196090 . . . 1196755) | ymfD | b1137 | orf, hypothetical protein |
| MDS11 | CDS | complement(1196756 . . . 1197460) | ymfE | b1138 | orf, hypothetical protein |
| MDS11 | CDS | 1197918 . . . 1198811 | lit | b1139 | phage T4 late gene expression; at locus of e14 element |
| MDS11 | CDS | complement(1198902 . . . 1200029) | intE | b1140 | prophage e14 integrase |
| MDS11 | CDS | complement(1200010 . . . 1200255) | | b1141 | |
| MDS11 | CDS | complement(1200292 . . . 1200603) | ymfH | b1142 | |
| MDS11 | CDS | 1200675 . . . 1201061 | ymfI | b1143 | |
| MDS11 | CDS | complement(1200999 . . . 1201283) | ymfJ | b1144 | |
| MDS11 | CDS | complement(1201482 . . . 1202156) | | b1145 | |
| MDS11 | CDS | 1201944 . . . 1202447 | | b1146 | |
| MDS11 | CDS | 1202479 . . . 1203048 | ymfL | b1147 | |
| MDS11 | CDS | 1203045 . . . 1203383 | ymfM | b1148 | |
| MDS11 | CDS | 1203393 . . . 1204760 | ymfN | b1149 | |
| MDS11 | CDS | 1204772 . . . 1204954 | ymfR | b1150 | |
| MDS11 | CDS | 1204954 . . . 1205427 | ymfO | b1151 | |
| MDS11 | CDS | 1205354 . . . 1206145 | | b1152 | |
| MDS11 | CDS | 1206136 . . . 1206720 | | b1153 | |
| MDS11 | CDS | 1206724 . . . 1207353 | ycfK | b1154 | |
| MDS11 | CDS | 1207355 . . . 1207768 | | b1155 | |
| MDS11 | CDS | complement(1207740 . . . 1208342) | ycfA | b1156 | |
| MDS11 | CDS | complement(1208342 . . . 1208881) | | b1157 | |
| MDS11 | CDS | 1208908 . . . 1209462 | pin | b1158 | inversion of adjacent DNA; at locus of e14 element |
| MDS11 | CDS | 1209569 . . . 1210402 | mcrA | b1159 | restriction of DNA at 5-methylcytosine residues; at locus of e14 element |
| MDS11 | CDS | complement(1210903 . . . 1211226) | ycgW | b1160 | orf, hypothetical protein |
| MDS11 | CDS | complement(1211926 . . . 1212330) | ycgX | b1161 | orf, hypothetical protein |
| MDS11 | CDS | complement(1212551 . . . 1213282) | ycgE | b1162 | putative transcriptional regulator |
| MDS11 | CDS | complement(1213487 . . . 1214698) | | b1163 | orf, hypothetical protein |
| MDS11 | CDS | 1215012 . . . 1215248 | ycgZ | b1164 | orf, hypothetical protein |
| MDS11 | CDS | 1215291 . . . 1215563 | ymgA | b1165 | orf, hypothetical protein |

TABLE 2-continued

| Strain | Type | Coordinates | Name | B | Function |
|---|---|---|---|---|---|
| MDS11 | CDS | 1215592 . . . 1215858 | ymgB | b1166 | orf, hypothetical protein |
| MDS11 | CDS | 1215971 . . . 1216219 | ymgC | b1167 | orf, hypothetical protein |
| MDS11 | CDS | 1216509 . . . 1218074 | | b1168 | putative proteases |
| MDS11 | CDS | 1218824 . . . 1220344 | | b1169 | putative ATP-binding component of a transport system |
| MDS11 | CDS | 1220429 . . . 1221445 | | b1170 | |
| MDS11 | CDS | complement(1221528 . . . 1221863) | | b1171 | orf, hypothetical protein |
| MDS11 | CDS | complement(1221867 . . . 1222151) | | b1172 | orf, hypothetical protein |
| MDS12 | CDS | complement(564038 . . . 565201) | intD | b0537 | prophage DLP12 integrase |
| MDS12 | CDS | 565195 . . . 565755 | | b0538 | putative sensory transduction regulator |
| MDS12 | CDS | complement(565321 . . . 565584) | | b0539 | |
| MDS12 | CDS | 566056 . . . 566364 | | b0540 | |
| MDS12 | CDS | 566361 . . . 567227 | tra5_2 | b0541 | |
| MDS12 | CDS | 567333 . . . 567470 | | b0542 | orf, hypothetical protein |
| MDS12 | CDS | 567538 . . . 567870 | emrE | b0543 | methylviologen resistance |
| MDS12 | CDS | 568125 . . . 569651 | ybcK | b0544 | orf, hypothetical protein |
| MDS12 | CDS | 570116 . . . 570667 | ybcL | b0545 | orf, hypothetical protein |
| MDS12 | CDS | 570677 . . . 571474 | ybcM | b0546 | putative ARAC-type regulatory protein |
| MDS12 | CDS | 571689 . . . 572144 | ybcN | b0547 | orf, hypothetical protein |
| MDS12 | CDS | 572144 . . . 572314 | ninE | b0548 | similar to phage 82 and lambda proteins |
| MDS12 | CDS | 572307 . . . 572597 | ybcO | b0549 | orf, hypothetical protein |
| MDS12 | CDS | 572594 . . . 572956 | rus | b0550 | endodeoxyribonuclease RUS (Holliday junction resolvase) |
| MDS12 | CDS | 573179 . . . 573562 | ybcQ | b0551 | orf, hypothetical protein |
| MDS12 | CDS | complement(573960 . . . 574976) | trs5_2 | b0552 | IS5 transposase |
| MDS12 | CDS | complement(574981 . . . 576108) | nmpC | b0553 | outer membrane porin protein; locus of qsr prophage |
| MDS12 | CDS | 576621 . . . 576836 | ybcR | b0554 | orf, hypothetical protein |
| MDS12 | CDS | 576836 . . . 577333 | ybcS | b0555 | bacteriophage lambda lysozyme homolog |
| MDS12 | CDS | 577330 . . . 577791 | ybcT | b0556 | bacteriophage lambda endopeptidase homolog |
| MDS12 | CDS | complement(577823 . . . 578116) | ybcU | b0557 | bacteriophage lambda Bor protein homolog |
| MDS12 | CDS | complement(578407 . . . 578859) | ybcV | b0558 | putative an envelop protein |
| MDS12 | CDS | 579103 . . . 579309 | ybcW | b0559 | orf, hypothetical protein |
| MDS12 | CDS | 580057 . . . 580602 | nohB | b0560 | bacteriophage DNA packaging protein |
| MDS12 | CDS | 580577 . . . 581320 | ybcX | b0561 | orf, hypothetical protein |
| MDS12 | CDS | complement(581375 . . . 581959) | ybcY | b0562 | orf, hypothetical protein |
| MDS12 | CDS | 582098 . . . 582283 | ylcE | b0563 | orf, hypothetical protein |
| MDS12 | CDS | 582904 . . . 583653 | appY | b0564 | regulatory protein affecting appA and other genes |
| MDS12 | CDS | complement(583903 . . . 584856) | ompT | b0565 | outer membrane protein 3b (a), protease VII |
| MDS13 | CDS | 15445 . . . 16557 | yi81_ | b0016 | IS186 hypothetical protein 1 |
| MDS13 | CDS | complement(15869 . . . 16177) | yi82_1 | b0017 | |
| MDS13 | CDS | complement(16751 . . . 16960) | mokC | b0018 | regulatory peptide whose translation enables hokC (gef) expression |
| MDS13 | CDS | 17489 . . . 18655 | nhaA | b0019 | Na+/H antiporter, pH dependent |
| MDS13 | CDS | 18715 . . . 19620 | nhaR | b0020 | transcriptional activator of nhaA |
| MDS13 | CDS | complement(19811 . . . 20314) | insB_1 | b0021 | IS1 protein InsB |
| MDS13 | CDS | complement(20233 . . . 20508) | insA | b0022 | IS1 protein InsA_1 |
| MDS13 | CDS | complement(16751 . . . 16903) | hokC | b4412 | small toxic membrane polypeptide |
| MDS13 | misc_RNA | 16952 . . . 17006 | sokC | b4413 | antisense RNA blocking mokC (orf69) and hokC (gef) translation |
| MDS14 | CDS | complement(602639 . . . 603886) | ybdG | b0577 | putative transport |
| MDS14 | CDS | complement(603994 . . . 604647) | nfnB | b0578 | oxygen-insensitive NAD(P)H nitroreductase |
| MDS14 | CDS | complement(604741 . . . 605109) | ybdF | b0579 | orf, hypothetical protein |
| MDS14 | CDS | complement(605174 . . . 605422) | ybdJ | b0580 | orf, hypothetical protein |
| MDS14 | CDS | complement(605488 . . . 606606) | ybdK | b0581 | orf, hypothetical protein |
| MDS14 | CDS | 607288 . . . 608400 | yi81_2 | b0582 | IS186 hypothetical protein |
| MDS14 | CDS | 607059 . . . 607211 | hokE | b4415 | small toxic membrane polypeptide |
| MDS15 | CDS | 2507652 . . . 2508908 | | b2389 | orf, hypothetical protein |
| MDS15 | CDS | 2509023 . . . 2509349 | ypeC | b2390 | orf, hypothetical protein |
| MDS15 | CDS | complement(2509490 . . . 2510728) | | b2392 | |
| MDS15 | CDS | 2511064 . . . 2512266 | nupC | b2393 | permease of transport system for3 nucleosides |
| MDS15 | CDS | 2512347 . . . 2513465 | yi81_3 | b2394 | |
| MDS15 | CDS | complement(2513665 . . . 2515971) | yfeA | b2395 | orf, hypothetical protein |
| MDS16 | CDS | complement(379293 . . . 380066) | yaiO | b0358 | orf, hypothetical protein |
| MDS16 | CDS | complement(380068 . . . 380511) | | b0359 | putative transferase |
| MDS16 | CDS | 380530 . . . 380940 | yi21_1 | b0360 | IS2 hypothetical protein |
| MDS16 | CDS | 380898 . . . 381803 | yi22_1 | b0361 | IS2 hypothetical protein |
| MDS16 | CDS | complement(381728 . . . 382114) | | b0362 | orf, hypothetical protein |
| MDS16 | CDS | complement(381963 . . . 383159) | yaiP | b0363 | polysaccharide metabolism |
| MDS16 | CDS | complement(383283 . . . 383693) | yaiS | b0364 | orf, hypothetical protein |
| MDS16 | CDS | 384399 . . . 385418 | tauA | b0365 | taurine transport system periplasmic protein |
| MDS16 | CDS | 385431 . . . 386198 | tauB | b0366 | taurine ATP-binding component of a transport system |

TABLE 2-continued

| Strain | Type | Coordinates | Name | B | Function |
|---|---|---|---|---|---|
| MDS16 | CDS | 386195 . . . 387022 | tauC | b0367 | taurine transport system permease protein |
| MDS16 | CDS | 387019 . . . 387870 | tauD | b0368 | taurine dioxygenase, 2-oxoglutarate-dependent |
| MDS17 | CDS | complement(389121 . . . 389390) | | b0370 | orf, hypothetical protein |
| MDS17 | CDS | 389475 . . . 390935 | yaiT | b0371 | orf, hypothetical protein |
| MDS17 | CDS | complement(390963 . . . 391829) | tra5_1 | b0372 | |
| MDS17 | CDS | complement(391826 . . . 392134) | | b0373 | putative flagellin structural protein |
| MDS17 | CDS | 392239 . . . 393642 | yaiU | b0374 | putative flagellin structural protein |
| MDS17 | CDS | 393685 . . . 394353 | yaiV | b0375 | orf, hypothetical protein |
| MDS17 | CDS | complement(394354 . . . 395511) | yaiH | b0376 | |
| MDS17 | CDS | 395863 . . . 397083 | sbmA | b0377 | sensitivity to microcin B17, possibly envelope protein |
| MDS17 | CDS | 397096 . . . 398190 | yaiW | b0378 | orf, hypothetical protein |
| MDS17 | CDS | complement(398249 . . . 398557) | yaiY | b0379 | orf, hypothetical protein |
| MDS17 | CDS | 398685 . . . 399029 | | b0380 | orf, hypothetical protein |
| MDS18 | CDS | complement(2992959 . . . 2993114) | | b2856 | orf, hypothetical protein |
| MDS18 | CDS | complement(2993336 . . . 2993767) | | b2857 | orf, hypothetical protein |
| MDS18 | CDS | complement(2993770 . . . 2993991) | | b2858 | orf, hypothetical protein |
| MDS18 | CDS | complement(2993984 . . . 2994409) | | b2859 | orf, hypothetical protein |
| MDS18 | CDS | complement(2994394 . . . 2995299) | yi22_4 | b2860 | IS2 hypothetical protein |
| MDS18 | CDS | complement(2995257 . . . 2995622) | yi21_4 | b2861 | IS2 hypothetical protein |
| MDS18 | CDS | complement(2995711 . . . 2996010) | | b2862 | orf, hypothetical protein |
| MDS18 | CDS | complement(2996056 . . . 2996892) | | b2863 | orf, hypothetical protein |
| MDS19 | CDS | 3182802 . . . 3183152 | | b3042 | orf, hypothetical protein |
| MDS19 | CDS | 3183436 . . . 3183987 | ygiL | b3043 | putative fimbrial-like protein |
| MDS19 | CDS | 3184209 . . . 3184574 | yi21_5 | b3044 | IS2 hypothetical protein |
| MDS19 | CDS | 3184532 . . . 3185437 | yi22_5 | b3045 | IS2 hypothetical protein |
| MDS19 | CDS | 3185422 . . . 3187887 | yqiG | b3046 | putative membrane protein |
| MDS19 | CDS | 3187894 . . . 3188652 | yqiH | b3047 | putative membrane protein |
| MDS19 | CDS | 3188654 . . . 3189718 | yqiI | b3048 | orf, hypothetical protein |
| MDS20 | CDS | complement(687220 . . . 688236) | trs5_3 | b0656 | IS5 transposase |
| MDS21 | CDS | 1386912 . . . 1387919 | ycjG | b1325 | putative muconate cycloisomerase I (EC 5.5 |
| MDS21 | CDS | complement(1387894 . . . 1388682) | ycjI | b1326 | putative carboxypeptidase |
| MDS21 | CDS | complement(1388957 . . . 1389889) | | b1327 | orf, hypothetical protein |
| MDS21 | CDS | 1390015 . . . 1390914 | ycjZ | b1328 | putative transcriptional regulator LYSR-type |
| MDS21 | CDS | 1391230 . . . 1392864 | | b1329 | |
| MDS21 | CDS | complement(1392915 . . . 1393946) | | b1330 | orf, hypothetical protein |
| MDS21 | CDS | 1394100 . . . 1395116 | trs5_4 | b1331 | IS5 transposase |
| MDS21 | CDS | 1395389 . . . 1395646 | ynaJ | b1332 | orf, hypothetical protein |
| MDS21 | CDS | complement(1395696 . . . 1396646) | ydaA | b1333 | orf, hypothetical protein |
| MDS22 | CDS | complement(2099919 . . . 2100935) | trs5_7 | b2030 | |
| MDS22 | CDS | complement(2100940 . . . 2101413) | yefJ | b2031 | |
| MDS22 | CDS | complement(2101415 . . . 2102533) | wbbK | b2032 | putative glucose transferase |
| MDS22 | CDS | complement(2102518 . . . 2103108) | wbbJ | b2033 | putative O-acetyl transferase |
| MDS22 | CDS | complement(2103089 . . . 2104081) | wbbI | b2034 | putative Galf transferase |
| MDS22 | CDS | complement(2104084 . . . 2105250) | wbbH | b2035 | O-antigen polymerase |
| MDS22 | CDS | complement(2105250 . . . 2106353) | glf | b2036 | UDP-galactopyranose mutase |
| MDS22 | CDS | complement(2106361 . . . 2107608) | rfbX | b2037 | putative O-antigen transporter |
| MDS22 | CDS | complement(2107605 . . . 2108162) | rfbC | b2038 | dTDP-6-deoxy-D-glucose-3,5 epimerase |
| MDS22 | CDS | complement(2108162 . . . 2109043) | rfbA | b2039 | glucose-1-phosphate thymidylyltransferase |
| MDS22 | CDS | complement(2109101 . . . 2110000) | rfbD | b2040 | dTDP-6-deoxy-L-mannose-dehydrogenase |
| MDS22 | CDS | complement(2110000 . . . 2111085) | rfbB | b2041 | dTDP-glucose 4,6 dehydratase |
| MDS22 | CDS | complement(2111458 . . . 2112351) | galF | b2042 | homolog of Salmonella UTP—glucose-1-P uridyltransferase, probably a UDP-gal transferase |
| MDS22 | CDS | complement(2112526 . . . 2113920) | wcaM | b2043 | orf, hypothetical protein |
| MDS22 | CDS | complement(2113931 . . . 2115151) | wcaL | b2044 | putative colanic acid biosynthesis glycosyl transferase |
| MDS22 | CDS | complement(2115148 . . . 2116428) | wcaK | b2045 | putative galactokinase (EC 2.7.1.6 |
| MDS22 | CDS | complement(2116704 . . . 2118182) | wzxC | b2046 | probable export protein |
| MDS22 | CDS | complement(2118184 . . . 2119578) | wcaJ | b2047 | putative colanic acid biosynthsis UDP-glucose lipid carrier transferase |
| MDS22 | CDS | complement(2119633 . . . 2121003) | cpsG | b2048 | phosphomannomutase |
| MDS22 | CDS | complement(2121108 . . . 2122544) | cpsB | b2049 | mannose-1-phosphate guanyltransferase |
| MDS22 | CDS | complement(2122547 . . . 2123770) | wcaI | b2050 | putative colanic biosynthesis glycosyl transferase |
| MDS22 | CDS | complement(2123767 . . . 2124249) | wcaH | b2051 | GDP-mannose mannosyl hydrolase |
| MDS22 | CDS | complement(2124249 . . . 2125214) | wcaG | b2052 | putative nucleotide di-P-sugar epimerase or dehydratase |
| MDS22 | CDS | complement(2125217 . . . 2126338) | gmd | b2053 | GDP-D-mannose dehydratase |
| MDS22 | CDS | complement(2126364 . . . 2126912) | wcaF | b2054 | putative transferase |
| MDS22 | CDS | complement(2126928 . . . 2127674) | wcaE | b2055 | putative colanic acid biosynthesis glycosyl transferase |
| MDS22 | CDS | complement(2127685 . . . 2128902) | wcaD | b2056 | putative colanic acid polymerase |
| MDS22 | CDS | complement(2128877 . . . 2130094) | wcaC | b2057 | putative glycosyl transferase |
| MDS22 | CDS | complement(2130091 . . . 2130579) | wcaB | b2058 | putative transferase |

TABLE 2-continued

| Strain | Type | Coordinates | Name | B | Function |
|---|---|---|---|---|---|
| MDS22 | CDS | complement(2130582 . . . 2131421) | wcaA | b2059 | putative regulator |
| MDS22 | CDS | complement(2131514 . . . 2133712) | | b2060 | |
| MDS22 | CDS | complement(2133679 . . . 2134122) | wzb | b2061 | low molecular weight protein-tyrosine-phosphatase |
| MDS22 | CDS | complement(2134128 . . . 2135267) | wza | b2062 | putative polysaccharide export protein |
| MDS23 | CDS | complement(2284412 . . . 2286922) | yejO | b2190 | putative ATP-binding component of a transport system |
| MDS23 | CDS | 2286927 . . . 2287049 | | b2191 | orf, hypothetical protein |
| MDS23 | CDS | complement(2287087 . . . 2288103) | trs5_8 | b2192 | IS5 transposase |
| MDS24 | CDS | 3360134 . . . 3360808 | yhcA | b3215 | putative chaperone |
| MDS24 | CDS | 3360829 . . . 3363210 | yhcD | b3216 | putative outer membrane protein |
| MDS24 | CDS | 3363207 . . . 3363686 | yhcE | b3217 | orf, hypothetical protein |
| MDS24 | CDS | complement(3363724 . . . 3364740) | trs5_10 | b3218 | IS5 transposase |
| MDS24 | CDS | 3364948 . . . 3365664 | yhcF | b3219 | putative transcriptional regulator |
| MDS25 | CDS | 3649314 . . . 3650096 | yhiS | b3504 | orf, hypothetical protein |
| MDS25 | CDS | complement(3650205 . . . 3651221) | trs5_11 | b3505 | IS5 transposase |
| MDS26 | CDS | complement(1128637 . . . 1129053) | flgN | b1070 | protein of flagellar biosynthesis |
| MDS26 | CDS | complement(1129058 . . . 1129351) | flgM | b1071 | anti-FliA (anti-sigma) factor; also known as RflB protein |
| MDS26 | CDS | complement(1129427 . . . 1130086) | flgA | b1072 | flagellar biosynthesis; assembly of basal-body periplasmic P ring |
| MDS26 | CDS | 1130241 . . . 1130657 | flgB | b1073 | flagellar biosynthesis, cell-proximal portion of basal-body rod |
| MDS26 | CDS | 1130661 . . . 1131065 | flgC | b1074 | flagellar biosynthesis, cell-proximal portion of basal-body rod |
| MDS26 | CDS | 1131077 . . . 1131772 | flgD | b1075 | flagellar biosynthesis, initiation of hook assembly |
| MDS26 | CDS | 1131797 . . . 1133005 | flgE | b1076 | flagellar biosynthesis, hook protein |
| MDS26 | CDS | 1133025 . . . 1133780 | flgF | b1077 | flagellar biosynthesis, cell-proximal portion of basal-body rod |
| MDS26 | CDS | 1133952 . . . 1134734 | flgG | b1078 | flagellar biosynthesis, cell-distal portion of basal-body rod |
| MDS26 | CDS | 1134787 . . . 1135485 | flgH | b1079 | flagellar biosynthesis, basal-body outer-membrane L (lipopolysaccharide layer) ring protein |
| MDS26 | CDS | 1135497 . . . 1136594 | flgI | b1080 | homolog of Salmonella P-ring of flagella basal body |
| MDS26 | CDS | 1136594 . . . 1137535 | flgJ | b1081 | flagellar biosynthesis |
| MDS26 | CDS | 1137601 . . . 1139244 | flgK | b1082 | flagellar biosynthesis, hook-filament junction protein 1 |
| MDS26 | CDS | 1139256 . . . 1140209 | flgL | b1083 | flagellar biosynthesis; hook-filament junction protein |
| MDS27 | CDS | complement(1960604 . . . 1960996) | flhE | b1878 | flagellar protein |
| MDS27 | CDS | complement(1960996 . . . 1963074) | flhA | b1879 | flagellar biosynthesis; possible export of flagellar proteins |
| MDS27 | CDS | complement(1963067 . . . 1964215) | flhB | b1880 | putative part of export apparatus for flagellar proteins |
| MDS27 | CDS | complement(1964417 . . . 1965061) | cheZ | b1881 | chemotactic response; CheY protein phophatase; antagonist of CheY as switch regulator |
| MDS27 | CDS | complement(1965072 . . . 1965461) | cheY | b1882 | chemotaxis regulator transmits chemoreceptor signals to flagelllar motor components |
| MDS27 | CDS | complement(1965476 . . . 1966525) | cheB | b1883 | response regulator for chemotaxis (cheA sensor); protein methylesterase |
| MDS27 | CDS | complement(1966528 . . . 1967388) | cheR | b1884 | response regulator for chemotaxis protein glutamate methyltransferase |
| MDS27 | CDS | complement(1967407 . . . 1969008) | tap | b1885 | methyl-accepting chemotaxis protein IV peptide sensor receptor |
| MDS27 | CDS | complement(1969054 . . . 1970715) | tar | b1886 | methyl-accepting chemotaxis protein II aspartate sensor receptor |
| MDS27 | CDS | complement(1970860 . . . 1971363) | cheW | b1887 | positive regulator of CheA protein activity |
| MDS27 | CDS | complement(1971384 . . . 1973348) | cheA | b1888 | sensory transducer kinase between chemosignal receptors and CheB and CheY |
| MDS27 | CDS | complement(1973353 . . . 1974279) | motB | b1889 | enables flagellar motor rotation linking torque machinery to cell wall |
| MDS27 | CDS | complement(1974276 . . . 1975163) | motA | b1890 | proton conductor component of motor; no effect on switching |
| MDS27 | CDS | complement(1975290 . . . 1975868) | flhC | b1891 | regulator of flagellar biosynthesis acting on class 2 operons; transcription initiation factor |
| MDS27 | CDS | complement(1975871 . . . 1976230) | flhD | b1892 | regulator of flagellar biosynthesis acting on class 2 operons; transcription initiation factor |
| MDS27 | CDS | complement(1976542 . . . 1977045) | insB_5 | b1893 | IS1 protein InsB |
| MDS27 | CDS | complement(1976964 . . . 1977239) | insA_5 | b1894 | IS1 protein InsA |
| MDS28 | CDS | complement(1995086 . . . 1995838) | yecC | b1917 | putative ATP-binding component of a transport system |

TABLE 2-continued

| Strain | Type | Coordinates | Name | B | Function |
|---|---|---|---|---|---|
| MDS28 | CDS | complement(1995835 . . . 1996503) | yecS | b1918 | putative transport system permease protein (former yecC) |
| MDS28 | CDS | complement(1996518 . . . 1997600) | yedO | b1919 | putative 1-aminocyclopropane-1-carboxylate deaminase |
| MDS28 | CDS | complement(1997609 . . . 1998409) | fliY | b1920 | putative periplasmic binding transport protein |
| MDS28 | CDS | complement(1998497 . . . 1999084) | fliZ | b1921 | orf, hypothetical protein |
| MDS28 | CDS | complement(1999094 . . . 1999813) | fliA | b1922 | flagellar biosynthesis; alternative sigma factor 28; regulation of flagellar operons |
| MDS28 | CDS | complement(2000134 . . . 2001630) | fliC | b1923 | flagellar biosynthesis; flagellin filament structural protein |
| MDS28 | CDS | 2001896 . . . 2003302 | fliD | b1924 | flagellar biosynthesis; filament capping protein; enables filament assembly |
| MDS28 | CDS | 2003327 . . . 2003737 | fliS | b1925 | flagellar biosynthesis; repressor of class 3a and 3b operons (RflA activity) |
| MDS28 | CDS | 2003737 . . . 2004102 | fliT | b1926 | flagellar biosynthesis; repressor of class 3a and 3b operons (RflA activity) |
| MDS28 | CDS | 2004180 . . . 2005667 | amyA | b1927 | cytoplasmic alpha-amylase |
| MDS28 | CDS | complement(2005701 . . . 2006114) | yedD | b1928 | orf, hypothetical protein |
| MDS28 | CDS | 2006301 . . . 2007506 | yedE | b1929 | putative transport system permease protein |
| MDS28 | CDS | 2007503 . . . 2007736 | yedF | b1930 | orf, hypothetical protein |
| MDS28 | CDS | 2007845 . . . 2008513 | yedK | b1931 | orf, hypothetical protein |
| MDS28 | CDS | 2008624 . . . 2009103 | yedL | b1932 | orf, hypothetical protein |
| MDS28 | CDS | complement(2009372 . . . 2009563) | | b1933 | orf, hypothetical protein |
| MDS28 | CDS | complement(2009573 . . . 2009893) | yedN | b1934 | orf, hypothetical protein |
| MDS28 | CDS | complement(2010025 . . . 2010375) | yedM | b1935 | orf, hypothetical protein |
| MDS28 | CDS | 2010526 . . . 2010804 | | b1936 | orf, hypothetical protein |
| MDS28 | CDS | complement(2010724 . . . 2011038) | fliE | b1937 | flagellar biosynthesis; basal-body component, possibly at (MS-ring)-rod junction |
| MDS28 | CDS | 2011253 . . . 2012911 | fliF | b1938 | flagellar biosynthesis; basal-body MS(membrane and supramembrane)-ring and collar protein |
| MDS28 | CDS | 2012904 . . . 2013899 | fliG | b1939 | flagellar biosynthesis, component of motor switching and energizing, enabling rotation and determinin its direction |
| MDS28 | CDS | 2013871 . . . 2014578 | fliH | b1940 | flagellar biosynthesis; export of flagellar proteins |
| MDS28 | CDS | 2014578 . . . 2015951 | fliI | b1941 | flagellum-specific ATP synthase |
| MDS28 | CDS | 2015970 . . . 2016413 | fliJ | b1942 | flagellar fliJ protein |
| MDS28 | CDS | 2016410 . . . 2017537 | fliK | b1943 | flagellar hook-length control protein |
| MDS28 | CDS | 2017642 . . . 2018106 | fliL | b1944 | flagellar biosynthesis |
| MDS28 | CDS | 2018111 . . . 2019115 | fliM | b1945 | flagellar biosynthesis, component of motor switch and energizing, enabling rotation and determining its direction |
| MDS28 | CDS | 2019112 . . . 2019525 | fliN | b1946 | flagellar biosynthesis, component of motor switch and energizing, enabling rotation and determining its direction |
| MDS28 | CDS | 2019588 . . . 2019893 | fliO | b1947 | flagellar biosynthesis |
| MDS28 | CDS | 2019893 . . . 2020630 | fliP | b1948 | flagellar biosynthesis |
| MDS28 | CDS | 2020640 . . . 2020909 | fliQ | b1949 | flagellar biosynthesis |
| MDS28 | CDS | 2020917 . . . 2021702 | fliR | b1950 | flagellar biosynthesis |
| MDS29 | CDS | 4552599 . . . 4553372 | uxuR | b4324 | regulator for uxu operon |
| MDS29 | CDS | complement(4553513 . . . 4554343) | yjiC | b4325 | orf, hypothetical protein |
| MDS29 | CDS | 4555007 . . . 4555408 | yjiD | b4326 | orf, hypothetical protein |
| MDS29 | CDS | complement(4555401 . . . 4556312) | yjiE | b4327 | putative transcriptional regulator LYSR-type |
| MDS29 | CDS | complement(4556377 . . . 4557549) | iadA | b4328 | isoaspartyl dipeptidase |
| MDS29 | CDS | complement(4557562 . . . 4558023) | yjiG | b4329 | orf, hypothetical protein |
| MDS29 | CDS | complement(4558020 . . . 4558715) | yjiH | b4330 | orf, hypothetical protein |
| MDS29 | CDS | 4558851 . . . 4559507 | yjiI | b4331 | orf, hypothetical protein |
| MDS29 | CDS | complement(4559520 . . . 4560698) | yjiJ | b4332 | putative transport protein |
| MDS29 | CDS | complement(4560766 . . . 4561737) | yjiK | b4333 | orf, hypothetical protein |
| MDS29 | CDS | complement(4561945 . . . 4562718) | yjiL | b4334 | putative enzyme |
| MDS29 | CDS | complement(4562722 . . . 4563894) | yjiM | b4335 | orf, hypothetical protein |
| MDS29 | CDS | complement(4563989 . . . 4565269) | yjiN | b4336 | orf, hypothetical protein |
| MDS29 | CDS | complement(4565310 . . . 4566542) | yjiO | p4337 | putative transport protein |
| MDS29 | CDS | 4567021 . . . 4567332 | yjiP | b4338 | orf, hypothetical protein |
| MDS29 | CDS | 4567381 . . . 4567941 | yjiQ | b4339 | orf, hypothetical protein |
| MDS29 | CDS | complement(4568185 . . . 4569597) | yjiR | b4340 | putative regulator |
| MDS29 | CDS | 4569774 . . . 4569938 | yjiS | b4341 | orf, hypothetical protein |
| MDS29 | CDS | 4570389 . . . 4571954 | yjiT | b4342 | orf, hypothetical protein |
| MDS29 | CDS | complement(4574935 . . . 4575981) | mcrC | b4345 | component of McrBC 5-methylcytosine restriction system |
| MDS29 | CDS | complement(4575981 . . . 4577378) | mcrB | b4346 | component of McrBC 5-methylcytosine restriction system |
| MDS29 | CDS | complement(4577522 . . . 4577920) | yjiW | b4347 | orf, hypothetical protein |
| MDS29 | CDS | complement(4578091 . . . 4579485) | hsdS | b4348 | specificity determinant for hsdM and hsdR |
| MDS29 | CDS | complement(4579482 . . . 4581071) | hsdM | b4349 | host modification; DNA methylase M |

TABLE 2-continued

| Strain | Type | Coordinates | Name | B | Function |
|---|---|---|---|---|---|
| MDS29 | CDS | complement(4581272 . . . 4584838) | hsdR | b4350 | host restriction; endonuclease R |
| MDS29 | CDS | 4584972 . . . 4585886 | mrr | b4351 | restriction of methylated adenine |
| MDS29 | CDS | complement(4585932 . . . 4586786) | yjiA | b4352 | orf, hypothetical protein |
| MDS29 | CDS | complement(4586899 . . . 4587102) | yjiX | b4353 | orf, hypothetical protein |
| MDS29 | CDS | complement(4587152 . . . 4589317) | yjiY | b4354 | putative carbon starvation protein |
| MDS29 | CDS | 4589680 . . . 4591335 | tsr | b4355 | methyl-accepting chemotaxis protein I serine sensor receptor |
| MDS29 | CDS | complement(4591384 . . . 4592745) | yjiZ | b4356 | putative transport protein, cryptic orf, joins former yjiZ and yjjL |
| MDS29 | CDS | complement(4592960 . . . 4593874) | yjjM | b4357 | orf, hypothetical protein |
| MDS29 | CDS | 4593998 . . . 4595035 | yjjN | b4358 | putative oxidoreductase |
| MDS29 | CDS | 4572158 . . . 4574878 | yjiV | b4486 | conserved hypothetical protein |
| MDS30 | CDS | 522485 . . . 526765 | rhsD | b0497 | rhsD protein in rhs element |
| MDS30 | CDS | 526805 . . . 527173 | | b0498 | orf, hypothetical protein |
| MDS30 | CDS | 527173 . . . 527883 | | b0499 | orf, hypothetical protein |
| MDS30 | CDS | 527864 . . . 528124 | ybbD | b0500 | orf, hypothetical protein |
| MDS30 | CDS | 528163 . . . 528354 | | b0501 | orf, hypothetical protein |
| MDS30 | CDS | complement(528869 . . . 529276) | | b0502 | orf, hypothetical protein |
| MDS31 | CDS | 728806 . . . 732999 | rhsC | b0700 | |
| MDS31 | CDS | 732593 . . . 732814 | | b0701 | |
| MDS31 | CDS | 732999 . . . 733325 | ybfB | b0702 | orf, hypothetical protein |
| MDS31 | CDS | 733443 . . . 734876 | | b0703 | orf, hypothetical protein |
| MDS31 | CDS | 734873 . . . 735442 | ybfC | b0704 | orf, hypothetical protein |
| MDS31 | CDS | 736327 . . . 737184 | ybfL | b0705 | putative receptor protein |
| MDS31 | CDS | 737315 . . . 738076 | ybfD | b0706 | putative DNA ligase |
| MDS32 | CDS | 1525914 . . . 1527962 | rhsE | b1456 | |
| MDS32 | CDS | 1527946 . . . 1528428 | ydcD | b1457 | orf, hypothetical protein |
| MDS32 | CDS | 1528610 . . . 1529356 | | b1458 | orf, hypothetical protein |
| MDS32 | CDS | 1529400 . . . 1529600 | | b1459 | orf, hypothetical protein |
| MDS32 | CDS | 1529840 . . . 1530976 | ydcC | b1460 | H repeat-associated protein (ORF-H) |
| MDS32 | CDS | 1531076 . . . 1531309 | ydcE | b1461 | orf, hypothetical protein |
| MDS32 | CDS | complement(1531306 . . . 1531923) | | b1462 | orf, hypothetical protein |
| MDS33 | CDS | 3616611 . . . 3617012 | yhhG | b3481 | |
| MDS33 | CDS | 3617215 . . . 3621450 | rhsB | b3482 | rhsB protein in rhs element |
| MDS33 | CDS | 3621437 . . . 3621805 | yhhH | b3483 | orf, hypothetical protein |
| MDS33 | CDS | 3622401 . . . 3623537 | yhhI | b3484 | putative receptor |
| MDS34 | CDS | complement(3759370 . . . 3759978) | yibF | b3592 | putative S-transferase |
| MDS34 | CDS | 3760206 . . . 3764339 | rhsA | b3593 | rhsA protein in rhs element |
| MDS34 | CDS | 3764360 . . . 3765202 | yibA | b3594 | orf, hypothetical protein |
| MDS34 | CDS | 3765244 . . . 3765945 | yibJ | b3595 | orf, hypothetical protein |
| MDS34 | CDS | 3766200 . . . 3766661 | yibG | b3596 | orf, hypothetical protein |
| MDS35 | CDS | complement(1041253 . . . 1043433) | yccC | b0981 | orf, hypothetical protein |
| MDS35 | CDS | complement(1043453 . . . 1043911) | yccY | b0982 | yccY putative phosphatase |
| MDS35 | CDS | complement(1043887 . . . 1045026) | yccZ | b0983 | putative function in exopolysaccharide production |
| MDS35 | CDS | complement(1045072 . . . 1047168) | ymcA | b0984 | orf, hypothetical protein |
| MDS35 | CDS | complement(1047168 . . . 1047914) | ymcB | b0985 | orf, hypothetical protein |
| MDS35 | CDS | complement(1047911 . . . 1048555) | ymcC | b0986 | putative regulator |
| MDS35 | CDS | complement(1048662 . . . 1048985) | ymcD | b0987 | orf, hypothetical protein |
| MDS35 | CDS | 1049250 . . . 1049753 | insB_4 | b0988 | IS1 protein InsB |
| MDS36 | CDS | complement(1085329 . . . 1085742) | ycdP | b1021 | orf, hypothetical protein |
| MDS36 | CDS | complement(1085744 . . . 1087069) | ycdQ | b1022 | orf, hypothetical protein |
| MDS36 | CDS | complement(1087062 . . . 1089080) | ycdR | b1023 | orf, hypothetical protein |
| MDS36 | CDS | complement(1089089 . . . 1091512) | ycdS | b1024 | putative outer membrane protein |
| MDS36 | CDS | 1092099 . . . 1093457 | ycdT | b1025 | orf, hypothetical protein |
| MDS36 | CDS | complement(1093498 . . . 1094364) | tra5_3 | b1026 | |
| MDS36 | CDS | complement(1094361 . . . 1094669) | | b1027 | |
| MDS36 | CDS | 1094746 . . . 1095069 | | b1028 | orf, hypothetical protein |
| MDS36 | CDS | 1095066 . . . 1096052 | ycdU | b1029 | orf, hypothetical protein |
| MDS37 | CDS | 2163174 . . . 2163545 | | b2080 | orf, hypothetical protein |
| MDS37 | CDS | 2163692 . . . 2165053 | yegQ | b2081 | orf, hypothetical protein |
| MDS37 | CDS | complement(2165326 . . . 2165544) | ogrK | b2082 | prophage P2 ogr protein |
| MDS37 | CDS | complement(2165626 . . . 2165772) | | b2083 | orf, hypothetical protein |
| MDS37 | CDS | complement(2165759 . . . 2166025) | | b2084 | orf, hypothetical protein |
| MDS37 | CDS | complement(2166013 . . . 2166390) | yegR | b2085 | orf, hypothetical protein |
| MDS37 | CDS | 2166736 . . . 2167635 | | b2086 | orf, hypothetical protein |
| MDS37 | CDS | complement(2167717 . . . 2168163) | gatR_1 | b2087 | split galactitol utilization operon repressor |
| MDS37 | CDS | 2168251 . . . 2168559 | | b2088 | |
| MDS37 | CDS | 2168556 . . . 2169422 | tra5_4 | b2089 | |
| MDS37 | CDS | complement(2169419 . . . 2169757) | gatR_2 | b2090 | |
| MDS37 | CDS | complement(2169857 . . . 2170897) | gatD | b2091 | galactitol-1-phosphate dehydrogenase |
| MDS37 | CDS | complement(2170945 . . . 2172300) | gatC | b2092 | PTS system galactitol-specific enzyme IIC |
| MDS37 | CDS | complement(2172304 . . . 2172588) | gatB | b2093 | galactitol-specific enzyme IIB of phosphotransferase system |
| MDS37 | CDS | complement(2172619 . . . 2173071) | gatA | b2094 | galactitol-specific enzyme IIA of phosphotransferase system |
| MDS37 | CDS | complement(2173081 . . . 2174343) | gatZ | b2095 | putative tagatose 6-phosphate kinase 1 |
| MDS37 | CDS | complement(2174372 . . . 2175232) | gatY | b2096 | tagatose-bisphosphate aldolase 1 |

TABLE 2-continued

| Strain | Type | Coordinates | Name | B | Function |
| --- | --- | --- | --- | --- | --- |
| MDS37 | misc_RNA | 2165136 . . . 2165221 | ryeE | b4438 | |
| MDS38 | CDS | complement(3577791 . . . 3578828) | yhhX | b3440 | putative regulator |
| MDS38 | CDS | 3579161 . . . 3579649 | yhhY | b3441 | orf, hypothetical protein |
| MDS38 | CDS | 3579886 . . . 3581064 | yhhZ | b3442 | orf, hypothetical protein |
| MDS38 | CDS | 3581061 . . . 3581477 | yrhA | b3443 | orf, hypothetical protein |
| MDS38 | CDS | 3581506 . . . 3581781 | insA_6 | b3444 | IS1 protein InsA |
| MDS38 | CDS | 3581700 . . . 3582203 | insB_6 | b3445 | IS1 protein InsB |
| MDS38 | misc_RNA | complement(3578946 . . . 3579039) | ryhB | b4451 | regulatory RNA mediating Fur regulon |
| MDS39 | CDS | 3718072 . . . 3718284 | cspA | b3556 | cold shock protein 7.4, transcriptional activator of hns |
| MDS39 | CDS | 3718703 . . . 3719224 | yi5A | b3557 | IS150 hypothetical protein |
| MDS39 | CDS | 3719221 . . . 3720072 | t150 | b3558 | IS150 putative transposase |
| MDS39 | CDS | complement(3718471 . . . 3718623) | hokA | b4455 | small toxic membrane polypeptide |
| MDS40 | CDS | 1869885 . . . 1871555 | yeaJ | b1786 | orf, hypothetical protein |
| MDS41 | CDS | 167484 . . . 169727 | fhuA | b0150 | outer membrane protein receptor for ferrichrome, colicin M, and phages T1, T5, and phi80 |
| MDS41 | CDS | 169778 . . . 170575 | fhuC | b0151 | ATP-binding component of hydroxymate-dependent iron transport |
| MDS41 | CDS | 170575 . . . 171465 | fhuD | b0152 | hydroxamate-dependent iron uptake cytoplasmic membrane component |
| MDS41 | CDS | 171462 . . . 173444 | fhuB | b0153 | hydroxamate-dependent iron uptake cytoplasmic membrane component |

SEQUENCE LISTING (1 sequence)

SEQ ID NO: 1 - DNA, 4639675 bp, Escherichia coli (residues 1-1,546,559 of 4,639,675)
agcttttcattctgactgcaacgggcaatatgtctctgtgtggattaaaaaaagagtgtctgatagcagcttctgaactggttacctgccgtgagtaaattaaaattttattgacttaggtcactaaatactttaaccaatataggcatagcgcacagacagataaaaattacagagtacacaacatccatgaaacgcattagcaccaccattaccaccaccatcaccattaccacaggtaacggtgcgggctgacgcgtacaggaaacacagaaaaaagcccgcacctgacagtgcgggctttttttttcgaccaaaggtaacgaggtaacaaccatgcgagtgttgaagttcggcggtacatcagtggcaaatgcagaacgttttctgcgtgttgccgatattctggaaagcaatgccaggcaggggcaggtggccaccgtcctctctgcccccgccaaaatcaccaaccacctggtggcgatgattgaaaaaaccattagcggccaggatgctttacccaatatcagcgatgccgaacgtatttttgccgaacttttgacgggactcgccgccgcccagccggggttcccgctggcgcaattgaaaactttcgtcgatcaggaatttgcccaaataaaacatgtcctgcatggcattagtttgttggggcagtgcccggatagcatcaacgctgcgctgatttgccgtggcgagaaaatgtcgatcgccattatggccggcgtattagaagcgcgcggtcacaacgttactgttatcgatccggtcgaaaaactgctggcagtggggcattacctcgaatctaccgtcgatattgctgagtccacccgccgtattgcggcaagccgcattccggctgatcacatggtgctgatggcaggtttcaccgccggtaatgaaaaaggcgaactggtggtgcttggacgcaacggttccgactactctgctgcggtgctggctgcctgtttacgcgccgattgttgcgagatttggacggacgttgacggggtctatacctgcgacccgcgtcaggtgcccgatgcgaggttgttgaagtcgatgtcctaccaggaagcgatggagctttcctacttcggcgctaaagttcttcacccccgcaccattacccccatcgcccagttccagatcccttgcctgattaaaaataccggaaatcctcaagcaccaggtacgctcattggtgccagccgtgatgaagacgaattaccggtcaagggcatttccaatctgaataacatggcaatgttcagcgtttctggtccggggatgaaagggatggtcggcatggcggcgcgcgtctttgcagcgatgtcacgcgcccgtatttccgtggtgctgattacgcaatcatcttccgaatacagcatcagtttctgcgttccacaaagcgactgtgtgcgagctgaacgggcaatgcaggaagagttctacctggaactgaaagaaggcttactggagccgctggcagtgacggaacggctggccattatctcggtggtaggtgatggtatgcgcaccttgcgtgggatctcggcgaaattctttgccgcactggcccgcgccaatatcaacattgtcgccattgctcagggatcttctgaacgctcaatctctgtcgtggtaaataacgatgatgcgaccactggcgtgcgcgttactcatcagatgctgttcaataccgatcaggttatcgaagtgtttgtgattggcgtcggtggcgttggcggtgcgctgctggagcaactgaagcgtcagcaaagctggctgaagaataaacatatcgacttacgtgtctgcggtgttgccaactcgaaggctctgctcaccaatgtacatggccttaatctggaaaactggcaggaagaactggcgcaagccaaagagccgtttaatctcgggcgcttaattcgcctcgtgaaagaatatcatctgctgaacccggtcattgttgactgcacttccagccaggcagtggcggatcaatatgccgacttcctgcgcgaaggtttccacgttgtcacgccgaacaaaaaggccaacacctcgtcgatggattactaccatcagttgcgttatgcggcggaaaaatcgcggcgtaaattcctctatgacaccaacgttggggctggattaccggttattgagaacctgcaaaatctgctcaatgcaggtgatgaattgatgaagttctccggcattctttctggttcgctttcttatatcttcggcaagttagacgaaggcatgagtttctccgaggcgaccacgctggcgcgggaaatgggttataccgaaccggacccgcgagatgatctttctggtatggatgtggcgcgtaaactattgattctcgctcgtgaaacgggacgtgaactggagctggcggatattgaaattgaacctgtgctgcccgcagagtttaacgccgagggtgatgttgccgcttttatggcgaatctgtcacaactcgacgatctctttgccgcgcgcgtggcgaaggcccgtgatgaaggaaaagttttgcgctatgttggcaatattgatgaagatggcgtctgccgcgtgaagattgccgaagtggatggtaatgatccgctgttcaaagtgaaaaatggcgaaaacgccctggccttctatagccactattatcagccgctgccgttggtactgcgcggatatggtgcgggcaatgacgttacagctgccggtgtctttgctgatctgctacgtaccctctcatggaagttaggagtctgacatggttaaagtttatgccccggcttccagtgccaatatgagcgtcgggtttgatgtgctcggggcggcggtgacacctgttgatggtgcattgctcggagatgtagtcacggttgaggcggcagagacattcagtctcaacaacctcggacgctttgccgataagctgccgtcagaaccacgggaaaatatcgtttatcagtgctgggagcgtttttgccaggaactgggtaagcaaattccagtggcgatgaccctggaaaagaatatgccgatcggttcgggcttaggctccagtgcctgttcggtggtcgcggcgctgatggcgatgaatgaacactgcggcaagccgcttaatgacactcgtttgctggctttgatgggcgagctggaaggccgtatctccggcagcattcattacgacaacgtggcaccgtgttttctcggtggtatgcagttgatgatcgaagaaaacgacatcatcagccagcaagtgccagggtttgatgagtggctgtgggtgctggcgtatccggggattaaagtctcgacggcagaagccagggctattttaccggcgcagtatcgccgccaggattgcattgcgcacgggcgacatctggcaggcttcattcacgcctgctattcccgtcagcctgagcttgccgcgaagctgatgaaagatgttatcgctgaaccctaccgtgaacggttactgccaggcttccggcaggcgcggcaggcggtcgcggaaatcggcgcggtagcgagcggtatctccggctccggcccgaccttgttcgctctgtgtgacaagccggaaaccgcccagcgcgttgccgactggttgggtaagaactacctgcaaaatcaggaaggttttgttcatatttgccggctggatacggcgggcgcacgagtactggaaaactaaatgaaactctacaatctgaaagatcacaacgagcaggtcagctttgcgcaagccgtaacccaggggttgggcaaaaatcaggggctgttttttccgcacgacctgccggaattcagcctgactgaaattgatgagatgctgaagctggattttgtcacccgcagtgcgaagatcctctcggcgtttattggtgatgaaatcccacaggaaatcctggaagagcgcgtgcgcgcggcgtttgccttcccggctccggtcgccaatgttgaaagcgatgtcggttgtctggaattgttccacgggccaacgctggcatttaaagatttcggcggtcgctttatggcacaaatgctgacccatattgcgggtgataagccagtgaccattctgaccgcgacctccggtgataccggagcggcagtggctcatgctttctacggtttaccgaatgtgaaagtggttatcctctatccacgaggcaaaatcagtccactgcaagaaaaactgttctgtacattgggcggcaatatcgaaactgttgccatcgacggcgatttcgatgcctgtcaggcgctggtgaagcaggcgtttgatgatgaagaactgaaagtggcgctagggttaaactcggctaactcgattaacatcagccgtttgctggcgcagatttgctactactttgaagctgttgcgcagctgccgcaggagacgcgcaaccagctggttgtctcggtgccaagcggaaacttcggcgatttgacggcgggtctgctggcgaagtcactcggtctgccggtgaaacgttttattgctgcgaccaacgtgaacgataccgtgccacgtttcctgcacgacggtcagtggtcacccaaagcgactcaggcgacgttatccaacgcgatggacgtgagtcagccgaacaactggccgcgtgtggaagagttgttccgccgcaaaatctggcaactgaaagagctgggttatgcagccgtggatgatgaaaccacgcaacagacaatgcgtgagttaaaagaactgggctacacttcggagccgcacgctgccgtagcttatcgtgcgctgcgtgatcagttgaatccaggcgaatatggcttgttcctcggcaccgcgcatccggcgaaatttaaagagagcgtggaagcgattctcggtgaaacgttggatctgccaaaagagctggcagaacgtgctgatttacccttgctttcacataatctgcccgccgattttgctgcgttgcgtaaattgatgatgaatcatcagtaaaatctattcattatctcaatcaggccgggtttgcttttatgcagcccggcttttttatgaagaaattatggagaaaaatgacagggaaaaaggagaaattctcaataaatgcggtaacttagagattaggattgcggagaataacaaccgccgttctcatcgagtaatctccggatatcgacccataacgggcaatgataaaaggagtaacctgtgaaaaagatgcaatctatcgtactcgcactttccctggttctggtcgctcccatggcagcacaggctgcggaaattacgttagtcccgtcagtaaaattacagataggcgatcgtgataatcgtggctattactgggatggaggtcactggcgcgaccacggctggtggaaacaacattatgaatggcgaggcaatcgctggcacctacacggaccgccgccaccgccgcgccaccataagaaagctcctcatgatcatcacggcggtcatggtccaggcaaacatcaccgctaaatgacaaatgccgggtaacaatccggcattcagcgcctgatgcgacgctggcgcgtcttatcaggcctacgttaattctgcaatatattgaatctgcatgcttttgtaggcaggataaggcgttcacgccgcatccggcattgactgcaaacttaacgctgctcgtagcgtttaaacaccagttcgccattgctggaggaatcttcatcaaagaagtaaccttcgctattaaaaccagtcagttgctctggtttggtcagccgattttcaataatgaaacgactcatcagaccgcgtgctttcttagcgtagaagctgatgatcttaaatttgccgttcttctcatcgaggaacaccggcttgataatctcggcattcaatttcttcggcttcaccgatttaaaatactcatctgacgccagattaatcaccacattatcgccttgtgctgcgagcgcctcgttcagcttgttggtgatgatatctccccagaattgatacagatctttccctcgggcattctcaagacggatccccatttccagacgataaggctgcattaaatcgagcgggcggagtacgccatacaagccggaaagcattcgcaaatgctgttgggcaaaatcgaaatcgtcttcgctgaaggtttcggcctgcaagccggtgtagacatcacctttaaacgccagaatcgcctggcgggcattcgccggcgtgaaatctggctgccagtcatgaaagcgagcggcgttgatacccgccagtttgtcgctgatgcgcatcagcgtgctaatctgcggaggcgtcagtttccgcgcctcatggatcaactgctgggaattgtctaacagctccggcagcgtatagcgcgtggtggtcaacgggctttggtaatcaagcgttttcgcaggtgaaataagaatcagcatatccagtccttgcaggaaatttatgccgactttagcaaaaaatgagaatgagttgatcgatagttgtgattactcctgcgaaacatcatcccacgcgtccggagaaagctggcgaccgatatccggataacgcaatggatcaaacaccgggcgcacgccgagtttacgctggcgtagataatcactggcaatggtatgaaccacaggcgagagcagtaaaatggcggtcaaattggtaatagccatgcaggccattatgatatctgccagttgccacatcagcggaaggcttagcaaggtgccgccgatgaccgttgcgaaggtgcagatccgcaaacaccagatcgctttagggttgttcaggcgtaaaaagaagagattgttttcggcataaatgtagttggcaacgatggagctgaaggcaaacagaataaccacaagggtaacaaactcagcaccccaggaacccattagcacccgcatcgccttctggataagctgaataccttccagcggcatgtaggttgtgccgttacccgccagtaatatcagcatggcgcttgccgtacagatgaccagggtgtcgataaaaatgccaatcatctggacaatcccttgcgctgccggatgcggaggccaggacgccgctgccgctgccgcgtttggcgtcgaacccattcccgcctcattggaaaacatactgcgctgaaaaccgttagtaatcgcctggcttaaggtatatcccgccgcgccgcctgccgcttcctgccagccaaaagcactctcaaaaatagaccaaatgacgtggggaagttgcccgatattcattacgcaaattaccaggctggtcagtacccagattatcgccatcaacgggacaaagccctgcatgagccgggcgacgccatgaagaccgcgagtgattgccagcagagtaaagacagcgagaataatgcctgtcaccagcgggggaaaatcaaaagaaaaactcagggcgcgggcaacggcgttcgcttgaactccgctgaaaattatgccataggcgatgagcaaaaagacggcgaacagaacgcccatccagcgcatccccagcccgcgcgccatataccatgccggtccgccacgaaactgcccattgacgtcacgttctttataaagttgtgccagagaacattcggcaaacgaggtcgccatgccgataaacgcggcaacccacatccaaaagacggctccaggtccaccggcggtaatagccagcgcaacgccggccaggttgccgctacccacgcgcgccgcaagactggtacacaatgactgaaatgaggttaaaccgcctggctgtggatgaatgctatttttaagacttttgccaaactggcggatgtagcgaaactgcacaaatccggtgcgaaaagtgaaccaacaacctgcgccgaagagcaggtaaatcattaccgatccccaaaggacgctgttaatgaaggagaaaaaatctggcatgcatatccctcttattgccggtcgcgatgactttcctgtgtaaacgttaccaattgtttaagaagtatatacgctacgaggtacttgataacttctgcgtagcatacatgaggttttgtataaaaatggcgggcgatatcaacgcagtgtcagaaatccgaaacagtctcgcctggcgataaccgtcttgtcggcggttgcgctgacgttgcgtcgtgatatcatcagggcagaccggttacatccccctaacaagctgtttaaagagaaatactatcatgacggacaaattgacctcccttcgtcagtacaccaccgtagtggccgacactggggacatcgcggcaatgaagctgtatcaaccgcaggatgccacaaccaacccttctctcattcttaacgcagcgcagattccggaataccgtaagttgattgatgatgctgtcgcctgggcgaaacagcagagcaacgatcgcgcgcagcagatcgtggacgcgaccgacaaactggcagtaaatattggtctggaaatcctgaaactggttccgggccgtatctcaactgaagttgatgcgcgtctttcctatgacaccgaagcgtcaattgcgaaagcaaaacgcctgatcaaactctacaacgatgctggtattagcaacgatcgtattctgatcaaactggcttctacctggcagggtatccgtgctgcagaacagctggaaaaagaaggcatcaactgtaacctgaccctgctgttctccttcgctcaggctcgtgcttgtgcggaagcgggcgtgttcctgatctcgccgtttgttggccgtattcttgactggtacaaagcgaataccgataagaaagagtacgctccggcagaagatccgggcgtggtttctgtatctgaaatctaccagtactacaaagagcacggttatgaaaccgtggttatgggcgcaagcttccgtaacatcggcgaaattctggaactggcaggctgcgaccgtctgaccatcgcaccggcactgctgaaagagctggcggagagcgaaggggctatcgaacgtaaactgtcttacaccggcgaagtgaaagcgcgtccggcgcgtatcactgagtccgagttcctgtggcagcacaaccaggatccaatggcagtagataaactggcggaaggtatccgtaagtttgctattgaccaggaaaaactggaaaaaatgatcggcgatctgctgtaatcattcttagcgtgaccgggaagtcggtcacgctacctcttctgaagcctgtctgtcactcccttcgcagtgtatcattctgtttaacgagactgtttaaacggaaaaatcttgatgaatactttacgtattggcttagtttccatctctgatcgcgcatccagcggcgtttatcaggataaaggcatccctgcgctggaagaatggctgacatcggcgctaaccacgccgtttgaactggaaacccgcttaatccccgatgagcaggcgatcatcgagcaaacgttgtgtgagctggtggatgaaatgagttgccatctggtgctcaccacgggcggaactggcccggcgcgtcgtgacgtaacgcccgatgcgacgctggcagtagcggaccgcgagatgcctggctttggtgaacagatgcgccagatcagcctgcattttgtaccaactgcgatcctttcgcgtcaggtgggcgtgattcgcaaacaggcgctgatccttaacttacccggtcagccgaagtctattaaagagacgctggaaggtgtgaaggacgctgagggtaacgttgtggtacacggtatttttgccagcgtaccgtactgcattcagttgctggaagggccatacgttgaaacggcaccggaagtggttgcagcattcagaccgaagagtgcaagacgcgacgttagcgaataaaaaaatccccccgagcggggggatctcaaaacaattagtgggattcaccaatcggcagaacggtgcgaccaaactgctcgttcagtacttcacccatcgccagatagattgcgctggcaccgcagatcagcccaatccagccggcaaagtggatgattgcggcgttaccggcaatgttaccgatcgccagcagggcaaacagcacggtcaggctaaagaaaacgaattgcagaacgcgtgcgcctttcagcgtgccgaagaacataaacagcgtaaatacgccccacagacccaggtagacaccaaggaactgtgcatttggcgcatcggtcagacccagtttcggcatcagcagaatcgcaaccagcgtcagccagaaagaaccgtaagaggtgaatgcggttaaaccgaaagtgttgccttttttgtactccagcagaccagcaaaaatttgcgcgatgccgccgtagaaaatgcccatggcaagaataataccgtccagagcgaaataacccacgttgtgcaggttaagcagaatggtggtcatgccgaagcccatcaggcccagcggtgccggattagccaacttagtgttgcccataattcctcaaaaatcatcatcgaatgaatggtgaaataatttccctgaataactgtagtgttttcagggcgcggcataataatcagccagtggggcagtgtctacgatcttttgaggggaaaatgaaaattttccccggtttccggtatcagacctgagtggcgctaaccatccggcgcaggcaggcgatttgcagtacggctggaatcgtcacgcgataggcgctgccgctgaccgctttaaccccatttagtgccgcacctacagggcctcccagccccgcgccgcgcagcaaaccatgcccaagtacgctcattgctgcgtgggtgcgtaaaatgcgggtcagttggctggaaagcaaatgcgacacaccttttgccaataatttgtctttcatcagcagcggcagcagctcttccagctcattcaccctggcatcgaccgcgtgcagaaactcctgcttatgttcctcgtccattttcttccaggtattacgcagaaattgttccagtaactgttgctcaatttcaaacgtagacatctctttgtcggctttcagcttcaatcgctttgaaacatcgagcaaaatggcccgatacaatttaccgtgtccgcgcagtttgttggcgatactatcgccaccaaaatgctgtaattctccggcaatcagctgccagttgcggcgatgttgctcgggatgcccttccatcgatttaaacagttcgttgcgcatcagtacgctggagaggcgagttttgcctttttcattatgggtgagcaatcgggcgaaatttgccaactgttcctcactacaatgctgaagaaaatccagatctgaatcattcaggtaattaacattcattttttgtggcttctatattctggcgttagtcgtcgccgataattttcagcgtggccatatccgatgagttcaccgtatgacccgaaaaggtgatttttgagacgcagcgtttattgtcgttatcgctgttaatgttgatccagtcagtggtttgcccttcttttatttctgaaggaatattcaggctctgactggcgctacgggcggctttgaaataaaccgatgcaccgcttaactgtaaatcgccatggtcggcagagagttgtatgcgtttcacaatgcgacaaacaggaagtttcagcgccagatcgttggtttcgttacgcggcattgcaatggcgccgaggagtttatggtcgtttgcctgcgccgtgcagcacagcatcaggctaatcgccaggctggcggaaatcgtaaaaacggatttcataaggattctcttagtgggaagaggtagggggatgaatacccactagtttactgctgataaagagaagattcaggcacgtaatcttttctttttattacaattttttgatgaatgccttggctgcgattcattctttatatgaataaaattgctgtcaattttacgtcttgtcctgccatatcgcgaaatttctgcgcaaaagcacaaaaaatttttgcatctcccccttgatgacgtggtttacgaccccatttagtagtcaaccgcagtgagtgagtctgcaaaaaaatgaaattgggcagttgaaaccagacgtttcgcccctattacagactcacaaccacatgatgaccgaatatatagtggagacgtttagatgggtaaaataattggtatcgacctgggtactaccaactcttgtgtagcgattatggatggcaccactcctcgcgtgctggagaacgccgaaggcgatcgcaccacgccttctatcattgcctatacccaggatggtgaaactctagttggtcagccggctaaacgtcaggcagtgacgaacccgcaaaacactctgtttgcgattaaacgcctgattggtcgccgcttccaggacgaagaagtacagcgtgatgtttccatcatgccgttcaaaattattgctgctgataacggcgacgcatgggtcgaagttaaaggccagaaaatggcaccgccgcagatttctgctgaagtgctgaaaaaaatgaagaaaaccgctgaagattacctgggtgaaccggtaactgaagctgttatcaccgtaccggcatactttaacgatgctcagcgtcaggcaaccaaagacgcaggccgtatcgctggtctggaagtaaaacgtatcatcaacgaaccgaccgcagctgcgctggcttacggtctggacaaaggcactggcaaccgtactatcgcggtttatgacctgggtggtggtactttcgatatttctattatcgaaatcgacgaagttgacggcgaaaaaaccttcgaagttctggcaaccaacggtgatacccacctggggggtgaagacttcgacagccgtctgatcaactatctggttgaagaattcaagaaagatcagggcattgacctgcgcaacgatccgctggcaatgcagcgcctgaaagaagcggcagaaaaagcgaaaatcgaactgtcttccgctcagcagaccgacgttaacctgccatacatcactgcagacgcgaccggtccgaaacacatgaacatcaaagtgactcgtgcgaaactggaaagcctggttgaagatctggtaaaccgttccattgagccgctgaaagttgcactgcaggacgctggcctgtccgtatctgatatcgacgacgttatcctcgttggtggtcagactcgtatgccaatggttcagaagaaagttgctgagttctttggtaaagagccgcgtaaagacgttaacccggacgaagctgtagcaatcggtgctgctgttcagggtggtgttctgactggtgacgtaaaagacgtactgctgctggacgttaccccgctgtctctgggtatcgaaaccatgggcggtgtgatgacgacgctgatcgcgaaaaacaccactatcccgaccaagcacagccaggtgttctctaccgctgaagacaaccagtctgcggtaaccatccatgtgctgcagggtgaacgtaaacgtgcggctgataacaaatctctgggtcagttcaacctagatggtatcaacccggcaccgcgcggcatgccgcagatcgaagttaccttcgatatcgatgctgacggtatcctgcacgtttccgcgaaagataaaaacagcggtaaagagcagaagatcaccatcaaggcttcttctggtctgaacgaagatgaaatccagaaaatggtacgcgacgcagaagctaacgccgaagctgaccgtaagtttgaagagctggtacagactcgcaaccagggcgaccatctgctgcacagcacccgtaagcaggttgaagaagcaggcgacaaactgccggctgacgacaaaactgctatcgagtctgcgctgactgcactggaaactgctctgaaaggtgaagacaaagccgctatcgaagcgaaaatgcaggaactggcacaggtttcccagaaactgatggaaatcgcccagcagcaacatgcccagcagcagactgccggtgctgatgcttctgcaaacaacgcgaaagatgacgatgttgtcgacgctgaatttgaagaagtcaaagacaaaaaataatcgccctataaacgggtaattatactgacacgggcgaaggggaatttcctctccgcccgtgcattcatctaggggcaatttaaaaaagatggctaagcaagattattacgagattttaggcgtttccaaaacagcggaagagcgtgaaatcagaaaggcctacaaacgcctggccatgaaataccacccggaccgtaaccagggtgacaaagaggccgaggcgaaatttaaagagatcaaggaagcttatgaagttctgaccgactcgcaaaaacgtgcggcatacgatcagtatggtcatgctgcgtttgagcaaggtggcatgggcggcggcggttttggcggcggcgcagacttcagcgatatttttggtgacgttttcggcgatatttttggcggcggacgtggtcgtcaacgtgcggcgcgcggtgctgatttacgctataacatggagctcaccctcgaagaagctgtacgtggcgtgaccaaagagatccgcattccgactctggaagagtgtgacgtttgccacggtagcggtgcaaaaccaggtacacagccgcagacttgtccgacctgtcatggttctggtcaggtgcagatgcgccagggattcttcgctgtacagcagacctgtccacactgtcagggccgcggtacgctgatcaaagatccgtgcaacaaatgtcatggtcatggtcgtgttgagcgcagcaaaacgctgtccgttaaaatcccggcaggggtggacactggagaccgcatccgtcttgcgggcgaaggtgaagcgggcgagcatggcgcaccggcaggcgatctgtacgttcaggttcaggttaaacagcacccgattttcgagcgtgaaggcaacaacctgtattgcgaagtcccgatcaacttcgctatggcggcgctgggtggcgaaatcgaagtaccgacccttgatggtcgcgtcaaactgaaagtgcctggcgaaacccagaccggtaagctattccgtatgcgcggtaaaggcgtcaagtctgtccgcggtggcgcacagggtgatttgctgtgccgcgttgtcgtcgaaacaccggtaggcctgaacgaaaggcagaaacagctgctgcaagagctgcaagaaagcttcggtggcccaaccggcgagcacaacagcccgcgctcaaagagcttctttgatggtgtgaagaagttttttgacgacctgacccgctaacctccccaaaagcctgcccgtgggcaggcctgggtaaaaatagggtgcgttgaagatatgcgagcacctgtaaagtggcggggatcactcccataagcgctaacttaagggttgtggtattacgcctgatatgatttaacgtgccgatgaattactctcacgataactggtcagcaattctggcccatattggtaagcccgaagaactggatacttcggcacgtaatgccggggctctaacccgccgccgcgaaattcgtgatgctgcaactctgctacgtctggggctggcttacggccccggggggatgtcattacgtgaagtcactgcatgggctcagctccatgacgttgcaacattatctgacgtggctctcctgaagcggctgcggaatgccgccgactggtttggcatacttgccgcacaaacacttgctgtacgcgccgcagttacgggttgtacaagcggaaagagattgcgtcttgtcgatggaacagcaatcagtgcgcccgggggcggcagcgctgaatggcgactacatatgggatatgatcctcatacctgtcagttcactgattttgagctaaccgacagcagagacgctgaacggctggaccgatttgcgcaaacggcagacgagatacgcattgctgaccggggattcggttcgcgtcccgaatgtatccgctcacttgcttttggagaagctgattatatcgtccgggttcactggcgaggattgcgctggttaactgcagaaggaatgcgctttgacatgatgggttttctgcgcgggctggattgcggtaagaacggtgaaaccactgtaatgataggcaattcaggtaataaaaaagccggagctccctttccggcacgtctcattgccgtatcacttcctcccgaaaaagcattaatcagtaaaacccgactgctcagcgagaatcgtcgaaaaggacgagtagttcaggcggaaacgctggaagcagcgggccatgtgctattgctaacatcattaccggaagatgaatattcagcagagcaagtggctgattgttaccgtctgcgatggcaaattgaactggcttttaagcggctcaaaagtttgctgcacctggatgctttgcgtgcaaaggaacctgaactcgcgaaagcgtggatatttgctaatctactcgccgcatttttaattgacgacataatccagccatcgctggatttcccccccagaagtgccggatccgaaaagaagaactaactcgttgtggagaataacaaaaatggtcatctggagcttacaggtggccattcgtgggacagtatccctgacagcctacaaaacgcaattgaagaacgcgaggcatcgtcttaacgaggcaccgaggcgtcgcattcttcagatggttcaacccttaagttagcgcttatgggatcactccccgccgttgctcttactcggattcgtaagccgtgaaaacagcaacctccgtctggccagttcggatgtgaacctcacagaggtcttttctcgttaccagcgccgccactacggcggtgatacagatgacgatcagggcgacaatcatcgccttatgctgcttcattgctctcttctccttgaccttacggtcagtaagaggcactctacatgtgttcagcatataggaggcctcgggttgatggtaaaatatcactcggggcttttctctatctgccgttcagctaatgcctgagacagacagcctcaagcacccgccgctattatatcgctctctttaacccattttgttttatcgattctaatcctgaagacgcctcgcatttttgtggcgtaattttttaatgatttaattatttaactttaatttatctcttcatcgcaattattgacgacaagctggattatttttgaaatattggcctaacaagcatcgccgactgacaacaaattaattattacttttcctaattaatccctcaggaatcctcaccttaagctatgattatctaggcttagggtcactcgtgagcgcttacagccgtcaaaaacgcatctcaccgctgatggcgcaaattcttcaatagctcgtaaaaaacgaattattcctacactataatctgattttaacgatgattcgtgcggggtaaaatagtaaaaacgatctattcacctgaaagagaaataaaaagtgaaacatctgcatcgattctttagcagtgatgcctcgggaggcattattcttatcattgccgctatcctggcgatgattatggccaacagcggcgcaaccagtggatggtatcacgactttctggagacgccggttcagctccgggttggttcactcgaaatcaacaaaaacatgctgttatggataaatgacgcgctgatggcggtatttttcctgttagtcggtctggaagttaaacgtgaactgatgcaaggatcgctagccagcttacgccaggccgcatttccagttatcgccgctattggtgggatgattgtgccggcattactctatctggcttttaactatgccgatccgattacccgcgaagggtgggcgatcccggcggctactgacattgcttttgcacttggtgtactggcgctgttgggaagtcgtgttccgttagcgctgaagatctttttgatggctctggctattatcgacgatcttggggccatcattatcatcgcattgttctacactaatgacttatcgatggcctctcttggcgtcgcggctgtagcaattgcggtactcgcggtattgaatctgtgtggtgcacgccgcacgggcgtctatattcttgttggcgtggtgttgtggactgcggtgttgaaatcgggggttcacgcaactctggcgggggtaattgtcggcttctttattcctttgaaagagaagcatgggcgttctccagcgaagcgactggagcatgtgttgcacccgtgggtggcgtatctgattttgccgctgtttgcatttgctaatgctggcgtttcactgcaaggcgtcacgctggatggcttgacctccattctgccattggggatcatcgctggcttgctgattggcaaaccgctggggattagtctgttctgctggttggcgctgcgtttgaaactggcgcatctgcctgagggaacgacttatcagcaaattatggtggtggggatcctgtgcggtatcggttttactatgtctatctttattgccagcctggcctttggtagcgtagatccagaactgattaactgggcgaaactcggtatcctggtcggttctatctcttcggcggtaattggatacagctggttacgcgttcgtttgcgtccatcagtttgacaggacggtttaccggggagccataaacggctcccttttcattgttatcagggagagaaatgagcatgtctcatatcaattacaaccacttgtattacttctggcatgtctataaagaaggttccgtggttggcgcagcggaggcgctttatttaactccacaaaccattaccggacagattcgagcgctggaagagcgcctgcaaggcaaattatttaaacgcaagggacgtggtctcgaacccagcgagctgggagaactggtctatcgctatgccgataaaatgttcaccttaagccaggaaatgctggatattgtgaactatcgcaaagaatccaatttattgtttgacgttggcgtggctgatgcactttccaaacgcctggtcagtagcgtacttaacgccgcagtggtagaaggcgagcccattcatcttcgctgcttcgaatccacccacgaaatgctgctggagcaattaagtcagcataaactggatatgatcatttctgactgtccgatagactctacgcagcaggaaggcctgttctccgtgagaattggcgaatgtggcgtgagtttctggtgtacaaatccaccaccagaaaaaccgttcccggcttgtctggaagaacggcgacttttgattcctgggcgacgttcaatgttagggcgcaaattgcttaactggtttaactcccagggattaaacgtagaaatcctcggcgagtttgatgatgccgctttgatgaaagcttttggtgcgatgcacaatgcaatcttcgttgccccaacgctttatgcatatgacttttatgccgataaaactgtcgtagaaattggtcgcgtcgagaatgtgatggaagagtaccatgctatttttgctgagcggatgattcagcacccggcggtacagcgaatctgcaatacggattattctgcgctttttagtccagcggtgcgttaatcggcagctcccccaaagttaaggtgggggagatagattagttgtacattaccacgattttgactcggctcattatttgcccgcttgagacattgtttccatatgtacgcgggcgaataaatagaggaatctgattacttccttcatggggatgctgaaaagagtagtaattgctggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggctgttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacctacctcaatgtgtatcacaatatccatattctttgtgggggagtctggagattgagtagatattcttgttcagaatgtatcagccgatggttctacgattcttaagccacgaagagttcagatagtacaacggcatgtctcttttgactatctggcaaccggcagtgtgttctctcacgcatcacaaaagcagcaggcataaaaaaacccgcttgcgcgggctttttcacaaagcttcagcaaattggcgattaagccagtttgttgatctgtgcagtcaggttagccttatgacgtgcagctttgtttttgtggatcagacctttagcagcctgacggtccacgatcggttgcatttcgttaaatgctttctgtgcagcagctttgtcgccagcttcgatagctgcgtatactttcttgatgaaagtacgcatcatagagcgacggcttgcgttgtgcttacgagccttttcagactgaatggcgcgcttcttagctgatttgatattagccaaggtccaactcccaaatgtgttctatatggacaattcaaaggccgaggaatatgcccttttagccttcttttgtcaatggatttgtgcaaataagcgccgttaatgtgccggcactcgttacgtagtgatggcgcaggattctaccagcttgcggggtgtgaatacagcttttccgcgataaaaattgcagcaggcggtcagtttcttcccgtgatttgcgccatggcaatgaaaagccacttctttctgatttcggtactcaatcgccggttaaccttgaccgctgtacaaggtatactcggacgattttcactgttttgagccagacatgaagctgatacgcggcatacataatctcagccaggccccgcaagaagggtgtgtgctgactattggtaatttcgacggcgtgcatcgcggtcatcgcgcgctgttacagggcttgcaggaagaagggcgcaagcgcaacttaccggtgatggtgatgctttttgaacctcaaccactggaactgtttgctaccgataaagccccggcaagactgacccggctgcgggaaaaactgcgttaccttgcagagtgtggcgttgattacgtgctgtgcgtgcgtttcgacaggcgtttcgcggcgttaaccgcgcaaaatttcatcagcgatcttctggtgaagcatttgcgcgtaaaatttcttgccgtaggtgatgatttccgctttggcgctggtcgtgaaggcgatttcttgttattacagaaagctggcatggaatacggcttcgatatcaccagtacgcaaactttttgcgaaggtggcgtgcgcatcagcagcaccgccgtgcgtcaggcccttgcggatgacaatctggctctggcagagagtttactggggcacccgtttgccatctccgggcgtgtagtccacggtgatgaattagggcgcactataggtttcccgacggcgaatgtaccgctgcgccgtcaggtttccccggtgaaaggggtttatgcggtagaagtgctgggcctcggtgaaaagccgttacccggcgtggcaaacatcggaacacgcccaacggttgccggtattcgccagcagctggaagtgcatttgttagatgttgcaatggacctttacggtcgccatatacaagtagtgctgcgtaaaaaaatacgcaatgagcagcgatttgcgtcgctggacgaactgaaagcgcagattgcgcgtgatgaattaaccgcccgcgaattttttgggctaacaaaaccggcttaagcctgttatgtaatcaaaccgaaatacggaaccgagaatctgatgagtgactataaatcaaccctgaatttgccggaaacagggttcccgatgcgtggcgatctcgccaagcgcgaacccggaatgctggcgcgttggactgatgatgatctgtacggcatcatccgtgcggctaaaaaaggcaaaaaaaccttcattctgcatgatggccctccttatgcgaatggcagcattcatattggtcactcggttaacaagattctgaaagacattatcgtgaagtccaaagggctttccggttatgactcgccgtatgtgcctggctgggactgccacggtctgccgatcgagctgaaagtcgagcaagaatacggtaagccgggtgagaaattcaccgccgccgagttccgcgccaagtgccgcgaatacgcggcgacccaggttgacggtcaacgcaaagactttatccgtctgggcgtgctgggcgactggtcgcacccgtacctgaccatggacttcaaaactgaagccaacatcatccgcgcgctgggcaaaatcatcggcaacggtcacctgcacaaaggcgcgaagccagttcactggtgcgttgactgccgttctgcgctggcggaagcggaagttgagtattacgacaaaacttctccgtccatcgacgttgctttccaggcagtcgatcaggatgcactgaaagcaaaatttgccgtaagcaacgttaacggcccaatctcgctggtaatctggaccaccacgccgtggactctgcctgccaaccgcgcaatctctattgcaccagatttcgactatgcgctggtgcagatcgacggtcaggccgtgattctggcgaaagatctggttgaaagcgtaatgcagcgtatcggcgtgaccgattacaccattctcggcacggtaaaaggtgcggagcttgagctgctgcgctttacccatccgtttatgggcttcgacgttccggcaatcctcggcgatcacgttaccctggatgccggtaccggtgccgttcacaccgcgcctggccacggcccggacgactatgtgatcggtcagaaatacggcctggaaaccgctaacccggttggcccggacggcacttatctgccgggcacttatccgacgctggatggcgtgaacgtcttcaaagcgaacgacatcgtcgttgcgctgctgcaggaaaaaggcgcgctgctgcacgttgagaaaatgcagcacagctatccgtgctgctggcgtcacaaaacgccgatcatcttccgcgcgacgccgcagtggttcgtcagcatggatcagaaaggtctgcgtgcgcagtcactgaaagagatcaaaggcgtgcagtggatcccggactggggccaggcgcgtatcgagtcgatggttgctaaccgtcctgactggtgtatctcccgtcagcgcacctggggtgtaccgatgtcactgttcgtgcacaaagacacggaagagctgcatccgcgtacccttgaactgatggaagaagtggcaaaacgcgttgaagtcgatggcatccaggcgtggtgggatctcgatgcgaaagagatcctcggcgacgaagctgatcagtacgtgaaagtgccggacacattggatgtatggtttgactccggatctacccactcttctgttgttgacgtgcgtccggaatttgccggtcacgcagcggacatgtatctggaaggttctgaccaacaccgcggctggttcatgtcttccctaatgatctccaccgcgatgaagggtaaagcgccgtatcgtcaggtactgacccacggctttaccgtggatggtcagggccgcaagatgtctaaatccatcggcaataccgtttcgccgcaggatgtgatgaacaaactgggcgcggatattctgcgtctgtgggtggcatcaaccgactacaccggtgaaatggccgtttctgacgagatcctgaaacgtgctgccgatagctatcgtcgtatccgtaacaccgcgcgcttcctgctggcaaacctgaacggttttgatccagcaaaagatatggtgaaaccggaagagatggtggtactggatcgctgggccgtaggttgtgcgaaagcggcacaggaagacatcctcaaggcgtacgaagcatacgatttccacgaagtggtacagcgtctgatgcgcttctgctccgttgagatgggttccttctacctcgacatcatcaaagaccgtcagtacaccgccaaagcggacagtgtggcgcgtcgtagctgccagactgcgctatatcacatcgcagaagcgctggtgcgctggatggcaccaatcctctccttcaccgctgatgaagtgtggggctacctgccgggcgaacgtgaaaaatacgtcttcaccggtgagtggtacgaaggcctgtttggcctggcagacagtgaagcgatgaacgatgcgttctgggacgagctgttgaaagtgcgtggcgaagtgaacaaagtcattgagcaagcgcgtgccgacaagaaagtgggtggctcgctggaagcggcagtaaccttgtatgcagaaccggaactgtcggcgaaactgaccgcgctgggcgatgaattacgatttgtcctgttgacctccggcgctaccgttgcagactataacgacgcacctgctgatgctcagcagagcgaagtactcaaagggctgaaagtcgcgttgagtaaagccgaaggtgagaagtgcccacgctgctggcactacacccaggatgtcggcaaggtggcggaacacgcagaaatctgcggccgctgtgtcagcaacgtcgccggtgacggtgaaaaacgtaagtttgcctgatgagtcaatcgatctgttcaacagggctacgctggctgtggctggtggtagtcgtgctgattatcgatctgggcagcaaatacctgatcctccagaactttgctctgggggatacggtcccgctgttcccgtcgcttaatctgcattatgcgcgtaactatggcgcggcgtttagtttccttgccgatagcggcggctggcagcgttggttctttgccggtattgcgattggtattagcgtgatcctggcagtgatgatgtatcgctcgaaggccacgcagaagctaaacaatatcgcttacgcgctgattattggcggcgcgctgggcaacctgttcgaccgcctgtggcacggcttcgttgtcgatatgatcgacttctacgtcggcgactggcacttcgccaccttcaaccttgccgatactgccatctgtgtcggtgcggcactgattgtgctggaaggttttttgccttctagagcgaaaaaacaataataaaccctgccggatgcgatgctgacgcatcttatccggcctacagattgctgcgaaatcgtaggccggataaggcgtttacgccgcatccggcaaaaatccttaaatataagagcaaacctgcatgtctgaatctgtacagagcaatagcgccgtcctggtgcacttcacgctaaaactcgacgatggcaccaccgccgagtctacccgcaacaacggtaaaccggcgctgttccgcctgggtgatgcttctctttctgaagggctggagcaacacctgttggggctgaaagtgggcgataaaaccaccttctcgttggagccagatgcggcgtttggcgtgccgtcaccggacctgattcagtacttctcccgccgtgaatttatggatgcaggcgagccagaaattggcgcaatcatgctttttaccgcaatggatggcagtgagatgcctggcgtgatccgcgaaattaacggcgactccattaccgttgatttcaaccatccgctggccgggcagaccgttcattttgatattgaagtgctggaaatcgatccggcactggaggcgtaacatgcagatcctgttggccaacccgcgtggtttttgtgccggggtagaccgcgctatcagcattgttgaaaacgcgctggccatttacggcgcaccgatatatgtccgtcacgaagtggtacataaccgctatgtggtcgatagcttgcgtgagcgtggggctatctttattgagcagattagcgaagtaccggacggcgcgatcctgattttctccgcacacggtgtttctcaggcggtacgtaacgaagcaaaaagtcgcgatttgacggtgtttgatgccacctgtccgctggtgaccaaagtgcatatggaagtcgcccgcgccagtcgccgtggcgaagaatctattctcatcggtcacgccgggcacccggaagtggaagggacaatgggccagtacagtaacccggaagggggaatgtatctggtcgaatcgccggacgatgtgtggaaactgacggtcaaaaacgaagagaagctctcctttatgacccagaccacgctgtcggtggatgacacgtctgatgtgatcgacgcgctgcgtaaacgcttcccgaaaattgtcggtccgcgcaaagatgacatctgctacgccacgactaaccgtcaggaagcggtacgcgccctggcagaacaggcggaagttgtgttggtggtcggttcgaaaaactcctccaactccaaccgtctggcggagctggcccagcgtatgggcaaacgcgcgtttttgattgacgatgcgaaagacatccaggaagagtgggtgaaagaggttaaatgcgtcggcgtgactgcgggcgcatcggctccggatattctggtgcagaatgtggtggcacgtttgcagcagctgggcggtggtgaagccattccgctggaaggccgtgaagaaaacattgttttcgaagtgccgaaagagctgcgtgtcgatattcgtgaagtcgattaagtcattagcagcctaagttatgcgaaaatgccggtcttgttaccggcattttttatggagaaaacatgcgtttacctatcttcctcgatactgaccccggcattgacgatgccgtcgccattgccgccgcgatttttgcacccgaactcgacctgcaactgatgaccaccgtcgcgggtaatgtctcggttgagaaaactacccgcaatgccctgcaactgctgcatttctggaatgcggagattccgctcgcccaaggggccgctgtgccactggtacgcgcaccgcgtgatgcggcatctgtgcacggcgaatcgggaatggctggctacgactttgttgagcacaaccgaaagccgctcgggataccggcgtttctggcgattcgggatgccctgatgcgtgcaccagagcctgttaccctggtggccatcggcccgttaaccaatattgcgctgttactttcacaatgcccggaatgcaagccgtatattcgccgtctggtgatcatgggtggttctgccggacgcggcaactgtacgccaaacgccgagtttaatattgctgccgatccagaagctgctgcctgtgtcttccgcagtggtattgaaatcgtcatgtgcggtttggatgtcaccaatcaggcaatattaactcctgactatctctctacactgccgcagttaaaccgtaccgggaaaatgcttcacgccctgtttagccactaccgtagcggcagtatgcaaagcggcttgcgaatgcacgatctctgcgccatcgcctggctggtgcgcccggacctgttcactctcaaaccctgttttgtggcagtggaaactcagggcgaatttacctcaggcacgacggtggttgatatcgacggttgcctgggcaagccagccaatgtacaggtggcattggatctggatgtgaaaggcttccagcagtgggtggctgaggtgctggctctggcgtcgtaacctgtcacatgttattggcatgcagtcattcatcgactcatgcctttcactgatatccctccctgtttatcattaatttctaattatcagcgtttttggctggcggcgtagcgatgcgctggttactctgaaaacggtctatgcaaattaacaaaagagaatagctatgcatgatgcaaacatccgcgttgccatcgcgggagccggggggcgtatgggccgccagttgattcaggcggcgctggcattagagggcgtgcagttgggcgctgcgctggagcgtgaaggatcttctttactgggcagcgacgccggtgagctggccggagccgggaaaacaggcgttaccgtgcaaagcagcctcgatgcggtaaaagatgattttgatgtgtttatcgattttacccgtccggaaggtacgctgaaccatctcgctttttgtcgccagcatggcaaagggatggtgatcggcactacggggtttgacgaagccggtaaacaagcaattcgtgacgccgctgccgatattgcgattgtctttgctgccaattttagcgttggcgttaacgtcatgcttaagctgctggagaaagcagccaaagtgatgggtgactacaccgatatcgaaattattgaagcacatcatagacataaagttgatgcgccgtcaggcaccgcactggcaatgggagaggcgatcgcccacgcccttgataaagatctgaaagattgcgcggtctacagtcgtgaaggccacaccggtgaacgtgtgcctggcaccattggttttgccaccgtgcgtgcaggtgacatcgttggtgaacataccgcgatgtttgccgatattggcgagcgtctggagatcacccataaggcgtccagccgtatgacatttgctaacggcgcggtaagatcggctttgtggttgagtggtaaggaaagcggtctttttgatatgcgagatgtacttgatctcaataatttgtaaccacaaaatatttgttatggtgcaaaaataacacatttaatttattgattataaagggctttaatttttggcccttttatttttggtgttatgtttttaaattgtctataagtgccaaaaattacatgttttgtcttctgtttttgttgttttaatgtaaattttgaccatttggtccacttttttctgctcgtttttatttcatgcaatcttcttgctgcgcaagcgttttccagaacaggttagatgatctttttgtcgcttaatgcctgtaaaacatgcatgagccacaaaataatataaaaaatcccgccattaagttgacttttagcgcccatatctccagaatgccgccgtttgccagaaattcgtcggtaagcagatttgcattgatttacgtcatcattgtgaattaatatgcaaataaagtgagtgaatattctctggagggtgttttgattaagtcagcgctattggttctggaagacggaacccagtttcacggtcgggccataggggcaacaggttcggcggttggggaagtcgttttcaatacttcaatgaccggttatcaagaaatcctcactgatccttcctattctcgtcaaatcgttactcttacttatccccatattggcaatgtcggcaccaatgacgccgatgaagaatcttctcaggtacatgcacaaggtctggtgattcgcgacctgccgctgattgccagcaacttccgtaataccgaagacctctcttcttacctgaaacgccataacatcgtggcgattgccgatatcgatacccgtaagctgacgcgtttactgcgcgagaaaggcgcacagaatggctgcattatcgcgggcgataacccggatgcggcgctggcgttagaaaaagcccgcgcgttcccaggtctgaatggcatggatctggcaaaagaagtgaccaccgcagaagcctatagctggacacaagggagctggacgttgaccggtggcctgccagaagcgaaaaaagaagacgagctgccgttccacgtcgtggcttatgattttggtgccaagcgcaacatcctgcggatgctggtggatagaggctgtcgcctgaccatcgttccggcgcaaacttctgcggaagatgtgctgaaaatgaatccagacggcatcttcctctccaacggtcctggcgacccggccccgtgcgattacgccattaccgccatccagaaattcctcgaaaccgatattccggtattcggcatctgtctcggtcatcagctgctggcgctggcgagcggtgcgaagactgtcaaaatgaaatttggtcaccacggcggcaaccatccggttaaagatgtggagaaaaacgtggtaatgatcaccgcccagaaccacggttttgcggtggacgaagcaacattacctgcaaacctgcgtgtcacgcataaatccctgttcgacggtacgttacagggcattcatcgcaccgataaaccggcattcagcttccaggggcaccctgaagccagccctggtccacacgacgccgcgccgttgttcgaccactttatcgagttaattgagcagtaccgtaaaaccgctaagtaatcaggagtaaaagagccatgccaaaacgtacagatataaaaagtatcctgattctgggtgcgggcccgattgttatcggtcaggcgtgtgagtttgactactctggcgcgcaagcgtgtaaagccctgcgtgaagagggttaccgcgtcattctggtgaactccaacccggcgaccatcatgaccgacccggaaatggctgatgcaacctacatcgagccgattcactgggaagttgtacgcaagattattgaaaaagagcgcccggacgcggtgctgccaacgatgggcggtcagacggcgctgaactgcgcgctggagctggaacgtcagggcgtgttggaagagttcggtgtcaccatgattggtgccactgccgatgcgattgataaagcagaagaccgccgtcgtttcgacgtagcgatgaagaaaattggtctggaaaccgcgcgttccggtatcgcacacacgatggaagaagcgctggcggttgccgctgacgtgggcttcccgtgcattattcgcccatcctttaccatgggcggtagcggcggcggtatcgcttataaccgtgaagagtttgaagaaatttgcgcccgcggtctggatctctctccgaccaaagagttgctgattgatgagtcgctgatcggctggaaagagtacgagatggaagtggtgcgtgataaaaacgacaactgcatcatcgtctgctctatcgaaaacttcgatgcgatgggcatccacaccggtgactccatcactgtcgcgccagcccaaacgctgaccgacaaagaatatcaaatcatgcgtaacgcctcgatggcggtgctgcgtgaaatcggcgttgaaaccggtggttccaacgttcagtttgcggtgaacccgaaaaacggtcgtctgattgttatcgaaatgaacccacgcgtgtcccgttcttcggcgctggcgtcgaaagcgaccggtttcccgattgctaaagtggcggcgaaactggcggtgggttacaccctcgacgaactgatgaacgacatcactggcggacgtactccggcctccttcgagccgtccatcgactatgtggttactaaaattcctcgcttcaacttcgaaaaattcgccggtgctaacgaccgtctgaccactcagatgaaatcggttggcgaagtgatggcgattggtcgcacgcagcaggaatccctgcaaaaagcgctgcgcggcctggaagtcggtgcgactggattcgacccgaaagtgagcctggatgacccggaagcgttaaccaaaatccgtcgcgaactgaaagacgcaggcgcagatcgtatctggtacatcgccgatgcgttccgtgcgggcctgtctgtggacggcgtcttcaacctgaccaacattgaccgctggttcctggtacagattgaagagctggtgcgtctggaagagaaagtggcggaagtgggcatcactggcctgaacgctgacttcctgcgccagctgaaacgcaaaggctttgccgatgcgcgcttggcaaaactggcgggcgtacgcgaagcggaaatccgtaagctgcgtgaccagtatgacctgcacccggtttataagcgcgtggatacctgtgcggcagagttcgccaccgacaccgcttacatgtactccacttatgaagaagagtgcgaagcgaatccgtctaccgaccgtgaaaaaatcatggtgcttggcggcggcccgaaccgtatcggtcagggtatcgaattcgactactgttgcgtacacgcctcgctggcgctgcgcgaagacggttacgaaaccattatggttaactgtaacccggaaaccgtctccaccgactacgacacttccgaccgcctctacttcgagccggtaactctggaagatgtgctggaaatcgtgcgtatcgagaagccgaaaggcgttatcgtccagtacggcggtcagaccccgctgaaactggcgcgcgcgctggaagctgctggcgtaccggttatcggcaccagcccggatgctatcgaccgtgcagaagaccgtgaacgcttccagcatgcggttgagcgtctgaaactgaaacaaccggcgaacgccaccgttaccgctattgaaatggcggtagagaaggcgaaagagattggctacccgctggtggtacgtccgtcttacgttctcggcggtcgggcgatggaaatcgtctatgacgaagctgacctgcgtcgctacttccagacggcggtcagcgtgtctaacgatgcgccagtgttgctggaccacttcctcgatgacgcggtagaagttgacgtggatgccatctgcgacggcgaaatggtgctgattggcggcatcatggagcatattgagcaggcgggcgtgcactccggtgactccgcatgttctctgccagcctacaccttaagtcaggaaattcaggatgtgatgcgccagcaggtgcagaaactggccttcgaattgcaggtgcgcggcctgatgaacgtgcagtttgcggtgaaaaacaacgaagtctacctgattgaagttaacccgcgtgcggcgcgtaccgttccgttcgtctccaaagccaccggcgtaccgctggcaaaagtggcggcgcgcgtgatggctggcaaatcgctggctgagcagggcgtaaccaaagaagttatcccgccgtactactcggtgaaagaagtggtgctgccgttcaataaattcccgggcgttgacccgctgttagggccagaaatgcgctctaccggggaagtcatgggcgtgggccgcaccttcgctgaagcgtttgccaaagcgcagctgggcagcaactccaccatgaagaaacacggtcgtgcgctgctttccgtgcgcgaaggcgataaagaacgcgtggtggacctggcggcaaaactgctgaaacagggcttcgagctggatgcgacccacggcacggcgattgtgctgggcgaagcaggtatcaacccgcgtctggtaaacaaggtgcatgaaggccgtccgcacattcaggaccgtatcaagaatggcgaatatacctacatcatcaacaccacctcaggccgtcgtgcgattgaagactcccgcgtgattcgtcgcagtgcgctgcaatataaagtgcattacgacaccaccctgaacggcggctttgccaccgcgatggcgctgaatgccgatgcgactgaaaaagtaatttcggtgcaggaaatgcacgcacagatcaaataatagcgtgtcatggcagatatttttcatccgctaatttgatcgaataactaatacggttctctgatgaggaccgtttttttttgcccattaagtaaatcttttggggaatcgatatttttgatgacataagcaggatttagctcacacttatcgacggtgaagttgcatactatcgatatatccacaattttaatatggccttgtttaattgcttcaaaacgagtcatagccagacttttaatttgtgaaactggagttcgtatgtgtgaaggatatgttgaaaaaccactctacttgttaatcgccgaatggatgatggctgaaaatcggtgggtgatagcaagagagatctctattcatttcgatattgaacacagcaaggcggttaataccctgacttatattctgtcggaagtcacagaaataagctgcgaagttaagatgatccctaataagctggaagggcggggatgccagtgtcagcgactggttaaagtggtcgatatcgatgagcaaatttacgcgcgcctgcgcaataacagtcgggaaaaattagtcggtgtaagaaagacgccgcgtattcctgccgttccgctcacggaacttaaccgcgagcagaagtggcagatgatgttgtcaaagagtatgcgtcgttaattttatctcgttgataccgggcgtcctgcttgccagatgcgatgttgtagcatcttatccagcaaccaggtcgcatccggcaagatcaccgtttaggcgtcacatccgtcgtcccctgcaaacgggggcgattttcctccatttgcctcagtggctgcgtttcatgtaacgatacatgacagcgcccgacaagatcctgatactctttggtattcaaccgtttccagtgtaactcgtcgtcactaacattgcgtacagcgcgggctggcgtacccatcaacaactggcgtttctcgccgcgaaagcccgctttgacaaagctcatggcggcaacaatgctctcttcgccaatgaccgcgccatccataatcacgctgttcatcccgaccaatgcatcgcgaccaatcaaacaaccatgcaggatcgctccgtgcccgatatggccgttttccccaacgatagtgtcagtgtcgcagtagccatgcataatgcagccatcctgaatattggctcccgcttgcacgatcaaccgcccgtagtcaccacgcagtgaggcgagtgggccgatgtagacaccggctcccacaatcacatcgccaatcaagacggcactgggatggacaaacgccgtcgggtgaaccaccggaattaacccctcaaaggcgtaatagctcacggttgttaacgtcctttccacaccggatcgcgcttctcggcaaacgccagcggcccttcaatggcatcttccgaatgcagaaccgatggatagtgtttcaacacgccgctgcgaatatagcgatacgcttcttctaccggcatttcgctggtggtgcggtagatctctttcagcgccgcaatcgccagcggggcgctgttaaccagctgctgagccagttcgcgggcgttatccatcagttccgcctggctaaccacgcggttgactatcccccaacgcagcgcctcttctgcgcccattcgtctgccggtcatcaccatttcattgacgatggcaggcggcaggatcttcggcagacgcagcacaccgccgctgtcaggaacgatgcccagtttggcttccggcagggcgaagctggcgttatcggcacaaacaataaaatctgccgccagcgccagttcaaagccgccgccaaaggcatagccgttcacagctgcgataaccggtttgtcgagattgaaaatttcggttaatcccgcaaaaccacccggaccaaagtcagcatccggtgcttcgccttctgctgccgcttttaaatcccagcccgcggaaaagaacttctctccggcaccggtaataatggcgacacgtaattgcggatcgtcacggaaatttagaaatacttcgcccatttcaaagctggtttttgcatcaatagcattcgcttttggacgatcaagggtaatttccagaattgatccattgcgggtcagatgtaatgattcactcattccttttctccatttttgctttttcagggacgacaacatccctgcaaaaaatgcatattgttttagagtgtgattattagctggcagggtagttccctgctgtttcatttatttcagattctttctaattattttccccgagcaattacgtggcagatcttttctgatctccagataagagggcactttaaatttcgccatattttgttcgcagaagcggaaaaattcctcttcgctcaatgtttcaccttcattcagcaccacaaatgctttgatggcttcatcgcgaatcgaatctttaatacccacaaccacgatgtcctgaattttcgggtgcgcggcgataatattttccagctccacgcaggagacattctcgccgccacgtttaatcatattgcagcggcgatcgacgaaataaaaaaagtcctcttcgtcgcggtatccggtatcgccggtatgcagccagccatcggcttccagcactttcgcagtggcttgtgggttgagaaagtactctttgaagatggttttcccaggtatgcctttaatgcagatttcaccgatctcaccagccgggagcgggcgattgtgatcgtcgcggatctccgcttcgtagcaaaaccccacccgaccaatcgacggccagcgtcgtttatcgccaggacgatcgccgataatgcccacaatggtttccgtcatcccataagacgtcagcaagcgaacgccgaagcgttcacaaaacgcatctttttcctgctccgacaagttgagataaaacatcacttcccgcaggcggtgttgctgatcgttcgctgaaggcggctgtaccatcaacgtacggatcatcatcggaatacattcggtaacggtggcgcggtacttctgtacctgtccccagaaggcgcgggcgctgtatttctcgaccagcacaaaggtggccccggcagaaaacgccgccatcgccgcagtacactggcaatcgatatgaaacgcaggcattaccgtcaggtagacgtcatcgtcacgcagtgcacactgccaggcggagtaatatccagcgaagcgcaggttgtaatgggtaatcaccacacctttcggtcgggaggtggtgccggaggtgaagagaatttccgccgtatcgtcagtcgatagcggcggtgcatagcacaaggtggcaggttgttgatttttcagttgagtaaacgaactcacgccatcatcagcgggaagtgccacatctgtcaggcaaatgtgccgcaattgagtggcatcttcctgctgaatctgttgatacataggatagaattgcgcactggtcaccagcaggcacgcctggctattttgcaggatccacgcgctttcctcgcacaacaggcgggcgttaatcggcaccataatcgcgccaatttttgccagcccgaaccagcaaaagataaattccgggcagttgtcgagatgtagtgcaaccttgtcgcctttgcgaatccccagcgtataaaacaggtttgccgtgcggttaatctcctgatttaactcaagataactataccggttaacgactccgccgctggattcacaaatcagcgccgttttatgaccgtaaacgtccgcaagatcgtcccacatttgacgtagatgttgtccgccaatgatatccattgcacctctatccatttttgttcgtttgttattgggcgggcgctagtcaggcaagccgactgacgccacgcgtttagtcctcaactttggccagacctttgctgaccaactcctgaatgtcgttttcgctgtagccgatatttttcaaaatggcagccgtgtccatgccatgtgagggcattccgcgccagatttgtccggggttatttttgaatttcggcatgatgttcggccctttgcaggtgcgaccatccatcgtttgccactgagtgattgattcgcgagccacatactgtggattgctttccagttccggtacggtcagcactttggcgcaggcgatattcagttcagcaaagcgttcttttacttccgcgatggtatgtgtcgccagccaggcatcgagtttctcttcaaccagtgggccgtaagggcattcgatacggtggataagctgagtgccttccgggatttctggcgtgccaagcagatgtgcgaggccaatatctttaaagcactcttcaatttgggtaatgcccaccagttccatcacgatgtagccgtcggcacatttatacagaccgcaaccggcgtagtagggatctttacctttgctcatgcgcgggcacatttcgccgccgttgaagtaatccatcatgaagtactggcccatacgcagcatcacttcatacatggcgatgtcgatactttcgcctttaccggtttcacgcactttatgcagtgctgccagcgccgccgtggtggcggtcaggccagaaaagtaatcggcggtatacgggaaggcaggcattggctggtcaacatcaccgttctgaatcaggtaaccactaaaggcctgggcgatagtgttataggccggaagattggtgtactcctcggtgccgtactgaccaaaaccggacaggtgagcgataaccagtttcgggttgtgctgccacagtacttcatcggtaatgccacgacgggcaaaggccggacctttactggcttcgatgaagatatcggtggtttccattaatttcagaaacgcttcgcggccttcatctttgaaaatatttaacgacagcgcgtgcaaattgcggcgggagagttgcgggtagttcggttgaacgcgaatggtgtcggcccaggcgacgttctcgatccagataacttccgcgccccattctgcgaacatttgcccggcaaacggtccggcgatttcgataccggagaagacaacgcgcaatccggccaacggcccgaatttcggcatgggtagatgatccattatttgctcctgaaaaatttatgtagcgcatgactgccggatgcggcgtaaacgctttatccggcctacattcgtgctcccgtaggcctgataagacgcatcagcgtcgcatcaggcagcgcacggacttagcggtattgcttcagcaccgcacgacccagcgtcaggatctgcatttcgtcagatcccccggagacgcggtctacacgcagatcacgccagaagcggctgatgcggtggttgcccgcaatcccgacaccgcccagcacctgcattgcgctatccacaacttcaaatgccgcattggcgcagaagtatttgcacatcgctgcatcgccagaggtgatggtgccgttgtctgctttccacgctgcttcatacagcatgtttttcatggagtttaatttgatcgccatgtgggcgaatttttcctgaatcaactggaaacgaccaatagcctcgccaaactgcacgcgctgattggcgtagcgcgccgcatcttcaaaggcgcacatcgccgtaccgtagttggtgagggctaccaggaaacgttcatggtcgaactcttctttgacgcggttaaagccgttaccttcccgaccgaacatgtctttctcgtccagttccacgtcgtcaaaggtgatttcacagcagctatccatacgcagaccgagcttttcaagtttggtcactttgatgcccggtttgctcatatcaacaaaccattcggtgtagacaggtttgtccggagaagccccgtcgcgcgccatcaccacgatgtacggggtgtaggcgctgctggtaataaaacacttactaccattaagataaatcttaccatttctacgggtataagtcgttttcaggctacccacgtcggagcccgcgcccggttcggtaatcgctgagttccacatctgcttaccggtgccgcggaaagccataattttgtcgatctgctcttgtgtgccttcgcgcaggaaggtgttgaacccgcccggcaactggtacagcacataggttggtgcccccagacgtcccagctccatccacacggcggcgagagtaacaaaccccgcgtccagaccaccgtgctcttcagggatcagcagactgtcgatacccatatccgccagtgctttgacaaaacgttccgggtagacgctgtcacggtcgcactcggcaaaataggcctcccagttttcgctggccatcagttcgcggataccggcgacaaacagttcctgctcatcatttaaattaaaatccatctttcaacctcttgatattttgggggttaattaatctttccagttctgtttcgcgtctttaataaaggagagcgtcaccataatgttgacgaagaacagcgggcatcctccggcgataatggcggtttgaatcggtttcaggccgccgagcgccagcagaacaataccgataatgccaaccagaattgaccaaccgatacgcaccagcagaggtggttcttcaccatcgcgtacttcgcggcaagtggacatcgccagggtataagagcaggcgttaaccagcgtaacggtggcaataaagcagaggatgaagaagccccacatggtggcggtgctgagtggcagagcggcccaggtttcaatgatggcgcgcgccacaccgtactgttcgatcagatttggaatgttgatgatgtttttatctatcaacagcagagtgttactaccgagtacagtccacaggatccaggttgacgctgtcagccccagcaccatgccgaagcacagttcacgcacagtacgaccacgggagatgcgggcgaggaagatactcatctggatagcataaatcacccaccatgcccagtagaacacggtccagccctgcgggaagccgcctttagcgatgggatcggtatagaacaacatgcgcggcagatacatcagcaacatccccaccgaatcggtgaagtagttcatgatgaagctggcaccgctgacaatgaacacccaacccagcatcaggaagctcaggtaactacgcacgtcactggcgatacgtacccctttttgcagaccgcaagcgacgcaaatggcgttgaggataatccagcaggtaatgatgatagcgtccagttgcagggtatgcggaatgccaaacaaccattgcatacactcggtcaccagcggcgtggcaaggcccagactggtacccatcgcgaagatcaaggcgacgagatagaagttgtcgacgatagtgccgaacaaccctttggcgtgtttttcacctaccagcggcaccagtgtcgagctggggcgaatcacttccattttgcggacaaagaagaagtaagcgaaggcgactgaaaggaagctgtaagtggcccacggcagaggtccccagtggaacaagctgtaagccagccccaactctttcgcccctgtcgagttcggttctaagccaaacggcggggtggagatgtagtagtagatctcaatcgatccccagaacagtacggcagcagacgtacaggaggcgaacatcataaagatccaactggcggtgctaaattctggcggttcgttacctaaacgctttttggcatacgggccaaacaccagccagaaccaaccgaaaagcatcaccaccatataccattcaaatgcccatccccatacattggtgacgtaactgaatacagcattaataacgacattcgctgcatccagatctctgactgtaagccaacaaagtatgccgacgattattaacggcggaaagaaaaccttcggttctattcccgtttttctcttttcattcttcatgagttaattccactgtgaaaacgaatatttattttgcgttcccgtttgttttatttttgttaacatttaatataattattattaacctcgtggacgcgttaatggctaactcataatgggtattcaataagctgtattctgtgattggtatcacatttttgtttcgggtgaatagagggcgttttttcgttaattttgattaataatcagtttgttatgctctgttgtgagtaaaaaataacatctgactttcaatattggtgatccataaaacaatattgaaaatttctttttgctacgccgtgttttcaatattggtgaggaacttaacaatattgaaagttggatttatctgcgtgtgacattttcaatattggtgattaaagttttatttcaaaattaaagggcgtgatatctgtaattaacaccaccgatatgaacgacgtttccttcatgatttctggagatgcaatgaagattattacttgctataagtgcgtgcctgatgaacaggatattgcggtcaataatgctgatggttcattagacttcagcaaagccgatgccaaaataagccaatacgatctcaacgctattgaagcggcttgccagctaaagcaacaggcagcagaggcgcaggtgacagccttaagtgtgggcggtaaagccctgaccaacgccaaagggcgtaaagatgtgctatcgcgcggcccggatgaactgattgtggtgattgatgaccagttcgagcaggcactgccgcaacaaacggcgagcgcactggctgcagccgcccagaaagcaggctttgatctgatcctctgtggcgatggttcttccgacctttatgcccagcaggttggtctgctggtgggcgaaatcctcaatattccggcagttaacggcgtcagcaaaattatctccctgacggcagataccctcaccgttgagcgcgaactggaagatgaaaccgaaaccttaagcattccgctgcctgcggttgttgctgtttccactgatatcaactccccacaaattccttcgatgaaagccattctcggcgcggcgaaaaagcccgtccaggtatggtcggcggcggatattggttttaacgcagaggcagcctggtcagaacaacaggttgccgcgccgaaacagcgcgaacgtcagcgcatcgtgattgaaggcgacggcgaagaacagatcgccgcatttgctgaaaatcttcgcaaagtcatttaattacaggggatgctatgaacacgttttctcaagtctgggtattcagcgataccccttctcgtctgccggaactgatgaacggtgcgcaggctttagctaatcaaatcaacacctttgtcctcaatgatgccgacggcgcacaggcaatccagctcggcgctaatcatgtctggaaattaaacggcaaaccggacgatcggatgatcgaagattacgccggtgtcatggctgacactattcgccagcacggcgcagacggcctggtgctgctgccaaacacccgtcgcggcaaattactggcggcaaaactgggttatcgccttaaagcggcggtgtctaacgatgccagcaccgtcagcgtacaggacggtaaagcgacagtgaaacacatggtttacggtggtctggcgattggcgaagaacgcattgccacgccgtatgcggtactgaccatcagcagcggcacgttcgatgcggctcagccagacgcgtcacgcactggcgaaacgcacaccgtggagtggcaggctccggctgtggcgattacccgcacggcaacccaggcgcgccagagcaacagcgtcgatctcgacaaagcccgtctggtggtcagcgtcggtcgcggtattggcagcaaagagaacattgcgctggcagaacagctttgcaaggcgataggtgcggagttggcctgttctcgtccggtggcggaaaacgaaaaatggatggagcacgaacgctatgtcggtatctccaacctgatgctgaaacctgaactgtacctggcggtggggatctccgggcagatccagcacatggttggcgctaacgcgtcgcaaaccattttcgccatcaataaagataaaaatgcgccgatcttccagtacgcggattacggcattgttggcgacgccgtgaagatccttccggcgctgaccgcagctttagcgcgttgatccactctggcagggctgcattttggccctgccgctgacagggagctcttatgtccgaagatatctttgacgccatcatcgtcggtgcagggcttgccggttcggttgccgcactggtgctcgcccgcgaaggtgcgcaagtgttagttatcgagcgtggcaattccgcaggtgccaagaacgtcaccggcgggcgtctctatgcccacagtctggaacacattattcctggtttcgccgactccgcccccgtagaacgcctgatcacccatgaaaaactcgcgtttatgacggaaaagtcagcgatgactatggactactgcaatggtgacgaaacctcgccatcccagcgttcttactccgttttgcgcagtaaatttgatgcctggctgatggagcaggccgaagaagcgggcgcgcagttaattaccgggatccgcgtcgataacctcgtacagcgcgatggcaaagtcgtcggtgtagaagccgatggcgatgtgattgaagcgaaaacggtgatccttgctgatggggtgaactccatccttgccgaaaaattggggatggcaaaacgcgtcaaaccgacggatgtggcggttggcgtgaaggaactgatcgagttaccgaagtcggttattgaagaccgttttcagttgcagggtaatcagggggcggcttgcctgtttgcgggatcacccaccgatggcctgatgggcggcggcttcctttataccaatgaaaacaccctgtcgctggggctggtttgtggtttgcatcatctgcatgacgcgaaaaaatcggtgccgcaaatgctggaagatttcaaacagcatccggccgttgcaccgctgatcgcgggcggcaagctggtggaatattccgctcacgtagtgccggaagcaggcatcaacatgctgccggagttggttggtgacggcgtattgattgccggtgatgccgccggaatgtgtatgaacctcggttttaccattcgcggtatggatctggcgattgccgccggggaagccgcagcaaaaaccgtgctttcagcgatgaaaagcgacgatttcagtaagcaaaaactggcggaatatcgtcagcatcttgagagtggtccgctgcgcgatatgcgtatgtaccagaaactaccggcgttccttgataacccacgcatgtttagcggctacccggagctggcggtgggtgtggcgcgtgacctgttcaccattgatggcagcgcgccggaactgatgcgcaagaaaatcctccgccacggcaagaaagtgggcttcatcaatctaatcaaggatggcatgaaaggagtgaccgttttatgacttctcccgtcaatgtggacgtcaaactgggcgtcaataaattcaatgtcgatgaagagcatccgcacattgttgtgaaggccgatgctgataaacaggcgctggagctgctggtgaaagcgtgccccgcaggtctgtacaagaagcaggatgacggcagtgtgcgcttcgattacgccggatgtctggagtgcggcacctgtcgcattctggggctggggtcggcgctggaacagtgggaatacccgcgcggcacctttggtgtggagttccgttacggctgatgttggtttgatacgtaacgccgcactgactctcattgcaaaaaacaggaataaccatgcaaccgtccagaaactttgacgatctcaaattctcctctattcaccgccgcattttgctgtggggaagcggtggtccgtttctggatggttatgtactggtaatgattggcgtggcgctggagcaactgacgccggcgctgaaactggacgctgactggattggcttgctgggcgcgggaacgctcgccgggctgttcgttggcacatcgctgtttggttatatttccgataaagtcggacggcgcaaaatgttcctcattgatatcatcgccatcggcgtgatatcggtggcgacgatgtttgtttcatcccccgtcgaactgttggtgatgcgggtacttatcggcattgtcatcggtgcagattatcccatcgccacctcaatgatcaccgagttctccagtacccgtcagcgggcgttttccatcagctttattgccgcgatgtggtatgtcggcgcgacctgtgccgatctggtcggctactggctttatgatgtggaaggcggctggcgctggatgctgggtagcgcggcgatcccctgtttgttgattttgattggtcgattcgaactgcctgaatctccccgctggttattacgcaaagggcgagtaaaagagtgcgaagagatgatgatcaaactgtttggcgaaccggtggctttcgatgaagagcagccgcagcaaacccgttttcgcgatctgtttaatcgccgccattttccttttgttctgtttgttgccgccatctggacctgccaggtgatcccaatgttcgccatttacacctttggcccgcaaatcgttggtttgttgggattgggggttggcaaaaacgcggcactagggaatgtggtgattagcctgttctttatgctcggctgtattccgccgatgctgtggttaaacactgccggacggcgtccattgttgattggcagctttgccatgatgacgctggcgctggcggttttggggctaatcccggatatggggatctggctggtagtgatggcctttgcggtgtatgcctttttctctggcgggccgggtaatttgcagtggctctatcctaatgaactcttcccgacagatatccgcgcctctgccgtgggcgtgattatgtccttaagtcgtattggcaccattgtttcgacctgggcactaccgatctttatcaataattacggtatcagtaacacgatgctaatgggggcgggtatctcgctgtttggcttgttgatttccgtagcgtttgccccggagactcgagggatgtcactggcgcagaccagcaatatgacgatccgcgggcagagaatggggtaaattgttcagatttctctcttttctgaatcaatattattgactataagccgcgtgaatatatgactacactttgtgggaaaacaaaggcgtaatcacgcgggctacctatgattcttataatttatgcgcatccgtatccgcatcattcccatgcgaataaacggatgcttgaacaggcaaggacgctggaaggcgtcgaaattcgctctctttatcaactctatcctgacttcaatatcgatattgccgccgagcaggaggcgctgtctcgcgccgatctgatcgtctggcagcatccgatgcagtggtacagcattcctccgctcctcaaactttggatcgataaagttttctcccacggctgggcttacggtcatggcggcacggcgctgcatggcaaacatttgctgtgggcggtgacgaccggcggcggggaaagccattttgaaattggtgcgcatccgggctttgatgtgctgtcgcagccgctacaggcgacggcaatctactgcgggctgaactggctgccaccgtttgccatgcactgcacctttatttgtgacgacgaaaccctcgaagggcaggcgcgtcactataagcaacgtctgctggaatggcaggaggcccatcatggatagccatacgctgattcaggcgctgatttatctcggttcggcagcgctgattgtacccattgcggtacgtcttggtctgggatcggtacttggctacctgatcgccggctgcattattggcccgtgggggctgcgactggtgaccgatgccgaatctattctgcactttgccgagattggggtggtgctgatgctgtttattatcggcctcgaactcgatccacaaaggctgtggaagctgcgtgcggcagtgttcggctgtggcgcattgcagatggtgatttgcggcggcctgctggggctgttctgcatgttacttgggctgcgctggcaggtcgcggaattgatcggcatgacgctggcgctctcctctacggcgattgccatgcaggcgatgaatgaacgcaatctgatggtgacgcaaatgggtcgcagtgcctttgcggtgctgctgttccaggatatcgcggcgatcccgctggtggcgatgattccgctactggcaacgagcagtgcctcgacgacgatgggcgcatttgctctctcggcgttaaaagtggcgggtgcgctggtgctggtggtattgctggggcgctatgtcacgcgtccggcgctgcgttttgtagcccgctctggcttgcgggaagtgtttagtgccgtggcgttattcctcgtgtttggctttggtttgctgctggaagaggtcggcttgtcgatggcgatgggcgcgtttctggcgggcgtactgctggcaagctcggaataccgtcatgcgctggagagcgatatcgaaccatttaaaggtttgctgttggggctgtttttcatcggtgttggcatgtcgatagactttggcacgctgcttgaaaacccattgcgcattgtcattttgctgctcggtttcctcatcatcaaaatcgccatgctgtggctgattgcccgaccgttgcaagtgccaaataaacagcgtcgttggtttgcggtgttgttagggcagggcagtgagtttgcctttgtggtatttggcgcggcgcagatggcgaatgtgctggagccggagtgggcgaaatcgctgaccctggcggtggcgctgtcgatggcagcaacgccgattctgctggtgatcctcaatcgccttgagcaatcttctactgaggaagcgcgtgaagccgatgagatcgacgaagaacagccgcgcgtgattatcgccggattcggtcgttttgggcagattaccggacgtttactgctctccagcggggtgaaaatggtggtactcgatcacgatccggaccatatcgaaaccttgcgtaaatttggtatgaaagtgttttatggcgatgccacgcggatggatttactggaatctgccggagcggcgaaagcggaagtgctgattaacgccatcgacgatccgcaaaccaacctgcaactgacagagatggtgaaagaacatttcccgcatttgcagattattgcccgcgcccgcgatgtcgaccactacattcgtttgcgtcaggcaggcgttgaaaagccggagcgtgaaaccttcgaaggtgcgctgaaaaccgggcgtctggcactggaaagtttaggtctggggccgtatgaagcgcgagaacgtgccgatgtgttccgccgctttaatattcagatggtggaagagatggcaatggttgagaacgacaccaaagcccgcgcggcggtctataaacgcaccagcgcgatgttaagtgagatcattaccgaggaccgcgaacatctgtcattaattcaacgacatggctggcagggaaccgaagaaggtaaacataccggcaacatggcggatgaaccggaaacgaaaccctcatcctaataaagagtgacgtaaatcacactttacagctaactgtttgtttttgtttcattgtaatgcggcgagtccagggagagagcgtggactcgccagcagaatataaaattttcctcaacatcatcctcgcaccagtcgacgacggtttacgctttacgtatagtggcgacaattttttttatcgggaaatctcaatgatcagtctgattgcggcgttagcggtagatcgcgttatcggcatggaaaacgccatgccgtggaacctgcctgccgatctcgcctggtttaaacgcaacaccttaaataaacccgtgattatgggccgccatacctgggaatcaatcggtcgtccgttgccaggacgcaaaaatattatcctcagcagtcaaccgggtacggacgatcgcgtaacgtgggtgaagtcggtggatgaagccatcgcggcgtgtggtgacgtaccagaaatcatggtgattggcggcggtcgcgtttatgaacagttcttgccaaaagcgcaaaaactgtatctgacgcatatcgacgcagaagtggaaggcgacacccatttcccggattacgagccggatgactgggaatcggtattcagcgaattccacgatgctgatgcgcagaactctcacagctattgctttgagattctggagcggcggtaattttgtatagaatttacggctagcgccggatgcgacgccggtcgcgtcttatccggccttcctatatcaggctgtgtttaagacgccgccgcttcgcccaaatccttatgccggttcgacggctggacaaaatactgtttatcttcccagcgcaggcaggttaatgtaccaccccagcagcagccggtatccagcgcgtatataccttccggcgtacctttgccctccagcgatgcccagtgaccaaaggcgatgctgtattcttcagcgacagggccaggaatcgcaaaccacggtttcagtggggcaggggcctcttccggcgattctttgctgtacatatccagttgaccgttcgggaagcaaaaacgcatacgggtaaaagcgttggtgataaaacgcagtcttcccagcccccgcaattccggtgaccagttatttggcatatcgccgtacatggcatcaagaaagaagggataggagtcactcgatagcaccgcttctacatcgcgtgcgcactctttggcggtctgcagatcccactgcggcgtgatccctgcgtgggccatcaccagctttttctcttcgtcgatttgcagcagaggctggcgccgcagccagttaagcagctcgtcggcatccggcgcttccagcagcggtgtcaggcgatctttcggtttattgcggctgatcccggcaaataccgccagcagatgcagatcgtgattgcccagcaccagacgtacgctgtcgcctaaggatttcacatagcgcagaacatccagcgaacccggcccgcgcgcgaccagatcgcccgtcagccagagggtatctttcccaggggtaaattctactttatgcagcaatgcgatcagttcatcgtaacaaccatgaacgtcgccaataaggtatgtcgccatattcttttaatgaatgagtgtgggaacggcgagtcggaatacgggaatgtcgatgctgaaagggacgccattttcatcgatcatttcgtagtgaccctgcatggtgcccagcggggtttcaatgattgcaccgctggtgtactggtactcttcgccaggcgcgataagtggctggacgccaaccactccttcgccctggacttcggtttcacggccattgccattggtgatcagccagtaacgccccaacaactgcactggcgctcgccccagattgcgtatggttacggtataagcaaaaacgtaacgttcattatcaggtgaagattgagcctcaatgtagacgctttgaacctgaatacacactcggggcgaattgatcatcgttaactctcctgcaaaggcgcgttctccgccagatagttcgccatctggcaatattgcgcgacagagatattttccgctcgcatcgccgggtcgatccccattcccgttaacacctcgacgctaaacaggttgccgaggctgttacgaatggttttacgacgctggttaaaggcttcggtggtgatgcggctcaacacacgaacatctttaaccgggtgaggcatcgttgcatgaggaaccaggcgcacgacggcggaatccactttgggtggtggtgtaaaggctgacggcggtacttccagtaccgggatcacattgcaatagtattgcgccatgacgcttaatcgaccatacgctttgctgttcggtcctgcaaccagacgattcaccacctctttttgcaacataaagtgcatgtcggcaatggcatcagtatagctaaacagatggaacatcaacggcgtggagatgttataaggcaggttgccgaaaacacgcagcggctgacccattttctcggccagttcaccaaagttaaaggtcatcgcatcctgctgataaatcgtcagtttcgggcctaagaatggatgcgtttgcagacgtgccgccagatcgcggtcaagttcgatgaccgtcagctggtccagacgttcgccgaccggttcggtcaatgccgccagaccggggccgatttcgaccatcgcctggcccttttgcgggttaatggcagacacaatactgtcgatcacgaactgatcgttgagaaagttttgcccgaagcgtttacgggctaagtggccctggtggactcgattattcattgggtgttaacaatcattttgatggcgagattaagcgccgtaataaaactgccgacatcggctttgccacgtcccgccagttcaagcgcggtgccgtggtccactgatgtgcgaataaagggcaggcccagcgtaatgttcacaccgcgcccgaagccctggtattttagcacgggaagaccctgatcgtggtacatcgccagcacggcgtcggcgttatcaagatatttcggctgaaacagggtatcggcaggcagcggcccgttgagtttcatcccctgcgcccgcagctcattgagcaccggaataatggtgtctatctcttccgtacccatatgaccgccttcgcccgcgtgcggattcagcccgcagaccagaatgcgcggttcggcaataccaaatttggtccgcaaatcgtgatgcaaaatagcaatcacttcgtgcaaaagtgcaggggtgatagcgtctgcgatatcgcgcagcggtaaatgcgtcgttgccagcgccacgcgaagttcttcggtcgccagcatcatcaccacctttttcgcctgcgaacgctcttcgaaaaactcggtatgaccggtaaaaggaatgccagcgtcgttaataacgcctttatgcaccggacctgtgatcagcgcggcaaattcgccgttcagacaaccatcgcacgctcgcgccagcgtttccaccacataatgcccattttcaaccgctaactgccccgcagtgacaggtgcacgtagcgcgacaggaagtagcgttaatgtgcccgcagtttgcggttgtgcaggggagttgggggaataagggcggagggtgagcggcaaaccgagcatcgctgcccggttggtaaggagagtggcatcggcacaaacaaccagttcgaccggccactcacgctgtgcaagctggacaactaagtccgggccaatcccggcgggctcgccgggagtgatcacaacacgttgggttttaaccattagttgctcaggattttaacgtaggcgctggcacgttgttcctgcatccagcttgctgcttcttccgagaacttacggttcatcagcatgcggtatgcacgatctttctgcgcagcgtcggttttatcgacattacgggtatccagcagttcgattaaatgccagccgaatgaagagtgaaccggtgcactcatttgacctttgttcaggcgagtcagggcgtcacggaaggccggatcgaaaatatctggtgtagcccagccgagatcgccgccctggttagcagagcctggatcctgagagaactctttcgctgcggcagcaaaagtcgttttaccactcttgatatcagcagcaatctgttccagtttcacacgggcctgttcgtcagtcatgatcggcgacggtttcagcagaatatggcgagcatgaacttcggtcaccgagatatttttgctttcgccgcgcaggtcgttaactttcagaatatggaagccaacgccggaacgaatcgggccaacaatgtcgcctttcttcgcggtgcttaatgcctgggcgaagatcccgggcaactcctgaatacggccccagcccatctggccgccgttcagcgcctgctggtcggcagaatgagcaatcgccagcttaccgaaatcagcgccgttacgcgcctgatcgacaatggcgcgcgcctggctttccgcttcgttcacctgatcagaggtcgggttttccggcagcgggatcaggatgtggctcaggttcagctcagtgctggcgtcgttttggttacccacctgctgcgccagggattcgacttcctgcggcaggatggtgatgcgacgacgcacctcgttgttacgcacttcagagataatcatctctttgcggatctggttacgataggtgttgtagttcagtccatcgtaagccagacggctgcgcatctgatccagcgtcatgttgttctgtttcgcgatgttagcaatcgcctgatccagctgctcatcggagattttcactcccattttctgccccatctgcaggatgatttgatccatgatcaaacgttccatgatttggtggcgcagcgtcgcgtcatcaggaagttgctgccttgcctgagcagcgttcagttttaccgactgcattaatccatcaacgtcgctttccagcacgacgccgttattgacgacggctgcgactttatcgactacctggggggcagcgaaactggtattcgcgatcatggcgataccgagaagcagcgttttccagttcttcatactttttccatttcaattaaccgcactgcggattacgtggtaaatcaacaaatcacaaagtgttttgatacggcagaatgttcgaacgcagcatctcttgcgtacccagaccgtagttggagctcaggccgcgaagttcgatgttaaagccgattgcgttgtcatataccgcatgttgtttatcgttatcccaaccgttcagcttccgctcgtaaccgacgcgaattgcatagcagcaggagctgtattgcacacctaacatagagtcggcttgcttgttagcattggtgtcgtagtagtaggccccaacaatggaccaacgatcggcaattggccagctggcgacagcacctacctgcgaaataccattcttatattgctcagcagtggaatagtacttaggcagcgtagcctgaatatattccgggctggcgtaacggtaattcagctgtaccagacggtcttcatcccgacggtattcaatgctggagttactggtcgctacgttatccagacgtgtatcgtactgaatcccgccacgcaatccccaacgctcggagatacgccagtaagtatcgcctgcccacaccagtgaacccgttttgtcgtcattctcccatgttatgttgtcatcgccagtgcgagactccgtgaaatagtagatttgaccaacggaaatattaaaacgttcaacggcagcatcatcatatatgcgagatgtgacaccggtcgtcacctggttagcggaggcaatacggtcaagaccgccgtaagtccggtcccggaacaggccagagtagtcagattgcagcagagacgagtcgtagttatagatgtcgctctgatcgcgatacggcacgtacaaatactgcgcgcgcggttccagcgtttgggtataacccggagccagcatttccatatcgcgttcaaagaccattttgccgtcaactttgaattgcggcattacgcggttaacggattcgtccagcttggtcgtgtttctggagttataccagtcaagattggtttgctgataatgggttgccagcaacttcgcttcggtattgatgctgccccagttattagagagcggcaaattgatggtcggttccaggtgaacacgggttgcttcaggcatgtcgtctctggtgttaacaaagtgcactgcctggccgtaaatacgcgtatcaaacggaccaacatcattctggtagtaattaacgtctaactgcggctctgccgagtagctactggtgttctgttcgctgaaaacctggaactgcttggttgaaacggtggcattgaagttttgcaccgcatagccaacgctgaatttttgcgttgcgtagccgtcagtactggaaccgtacttgttatcgaaatcattgaagtagctaggatcgctgaccttggtgtagtcgacgttgaaacgccacacctgatccatgaccccggagtggttccagtagaataaccaacgacgtgaactgtcatcgttcgggtgttcatcttcatagactttatctgaaggcagatagtccagttccatcaagccagcgcccgcctgggagaggtagcggaattcgttctcccacatgatgttgccacgacgatgcatataatgcggcgtgatggtggcatccatatttggcgcgatgttccagtaatatggcaggtagaactcaaagtagttggtggtggtgtacttggcgttcgggatcaagaaaccagagcgacgtttgtcacccaccggcaactgcaaataggggctataaaagatcggtaccggacccaccttaaagcgggcgttccagatctccgcaacttgttcttcgcggtcatgaataatttcgctacctaccacgctccaggtgtcagaacccggcagacaggaggtaaagctaccgttatccagaatggtatagcggttttcgccacgttgtttcatcaggtccgctttaccgcgaccctggcgacccaccatctggtaatcaccttcccagacgttggtatctttggtgttcagattcgcccagcctttcggccctttgaggatcacctggttatcgtcgtaatggacattaccgagcgcatcaacggtacgtaccggctccggttgtcctggtgcctctttttgatggagctgcacttcgtcggcctgcagacggctgttaccctgcatgatatccacgctgccagtaaacacggcgtcatccgggtagtcccctttcgcgtggtcagcattgatagtcacgggtaagtcattggtatcgccctgtaccagaggacggtcatagcttggcacgcccaacatgcactgtgaggcgaggtcggctgccagtccctgttgactataaagggcggtggcaatcatggtggccaggagagtggggatacgttttttcatacgttgattttattgttccatcatcggtaacgttgcgcgtgacaaacggtcagagactaacgtactcgtcatctctacgctagtgttaatcctgtccgaatagcgtcagtggtgttaggcacggcattgaatgacaggtatgataatgcaaattataggcgatgtcccacaattgaccgcagccggaaaacggtaaaagcacctttatattgtgggagatagccctgatatccgtgtgtcgatttggggaatatatgcagtattggggaaaaatcattggcgtggccgtggccttactgatgggcggcggcttttggggcgtagtgttaggcctgttaattggccatatgtttgataaagcccgtagccgtaaaatggcgtggttcgccaaccagcgtgagcgtcaggcgctgttttttgccaccacttttgaagtgatggggcatttaaccaaatccaaaggtcgcgtcacggaggctgatattcatatcgccagccagttgatggaccgaatgaatcttcatggcgcttcccgtactgcggcgcaaaatgcgttccgggtgggaaaatcagacaattacccgctgcgcgaaaagatgcgccagtttcgcagtgtctgctttggtcgttttgacttaattcgtatgtttctggagatccagattcaggcggcgtttgctgatggttcactgcacccgaatgaacgggcggtgctgtatgtcattgcagaagaattagggatctcccgcgctcagtttgaccagtttttgcgcatgatgcagggcggtgcacagtttggcggcggttatcagcagcaaactggcggtggtaactggcagcaagcgcagcgtggcccaacgctggaagatgcctgtaatgtgctgggcgtgaagccgacggatgatgcgaccaccatcaaacgtgcctaccgtaagctgatgagtgaacaccatcccgataagctggtggcgaaaggtttgccgcctgagatgatggagatggcgaagcagaaagcgcaggaaattcagcaggcatatgagctgataaagcagcagaaagggtttaaatgaccctgtaaatgatgctgagtaactgcccacgattaaaggtggccgccctggcggtcacttctttgagaaaaggcgtttactcagaatggtggacaggctcaatgcacggtttacgggaggggttctgtaggttttatcgcgttgaccctgcttaaggttgagagctttacgacgagcggaattatatttttacgtcttaaaaataaaaaacacatacctgaatgagcgatttttgaaagtatatttattcagaacgcgcatcatgagtttttaactcaatgcgaggctattaccatgaaagtatcagttccaggcatgccggttacacttttaaatatgagcaagaacgatatttataagatggtgagcggggacaagatggacgtgaagatgaatatctttcaacgcttgtgggagacgttacgccatctgttctggtcagataaacagactgaggcttataaacttctgttcaatttcgtgaataaccagactggcaacatcaacgcctcagaatactttactggggctatcaacgagaatgagagagaaaagtttatcaatagcctggaattattcaataaacttaaaacatgcgcaaaaaatccggatgagttggtcgcaaagggcaatatgcgctgggtcgcccagaccttcggggatatcgagttaagtgtcacttttttcattgaaaagaataagatatgtactcagacgttgcagctgcataagggccaaggtaacttgggcgttgatcttagaaaggcttaccttcccggcgttgacatgagggattgttaccttggtaaaaaaacaatgaaaggtagcaatgatatcctttatgagagacctgggtggaatgctaacctgggcgtgctaccccggacggtgctaccccggacggtgctaacccggacggtgctaacctggacggtgctaccgtgaacggtgctacctccttatatgatgaggtaattattattaataaaatcccccccaaaaaaattgatactaaaggagttgctactgaagaagttgctactaaaaaagtactgctgaacaaattactgacaacgcaattattgaatgagccagaataagctaaggttgaaggggctggaacgccccttcaaccttagcagtagcgtgggatgatttcacaattagaaagacctgcatgatgagctagagaagaggctagtgacgcaaggcgtcgtgcaggacacggatcaccgagatgggcatcgccaaccagactgctaattagcccatgaataacaatcagaaaggaccataacagacccgttaaaatgaaatataagagacggtcaacgggtgaagaaaaagttcaaaaattcgctgtggagcaggaagggaattaccgaatggaaagcgtagccacacgcaacaactgaaagcagtttggcagaaacaaaaaatccccggactcggggatttatgtacaagaggcagcccttaggatgagggtataaacgtacaggaaaggttaaaaatccgctggcgctttaaacgtcatactattgccatacgccggatgggtaatcgtcaacatctctgcatgtagcaacaaacgtggtgccatcgctctcgcttctggtgatgcataaaaacgatcgccgagaatcggatgacccagcgccagcatatgcacacgcaattgatgcgaacgcccggtaatcggttttaacaccactcttgccgtgttatccgccgcatactccaccacttcatattccgtctgcgcaggtttacccgtttcgtaacagactttctgtttcgggcggtttggccagtcgcaaatcagcggcagatccaccagaccttctgcgggggatggatgcccccagacgcgggccacatactgctttttcggctcgcgctcgcggaactggcgttttaactcccgctccgcggctttggtcagcgccactacaatcacgccgctggtagccatatccagacgatgcaccgattctgcctgcggataatcacgctgaatgcgcgtcatcacgctgtctttgtgctcttccagacgacccggcactgacaacaaaccgctcggcttgttgaccaccataatatggtcatcctgatacaggataaccaaccagggttcctgcggtggattgtagttttccatccccattttcggctccgttactgatgcgttacaacgatcaaacgcagggcatccagacgccaacctgcctgatccaggctttccattacctgctgacggttgctctcaatggcggtcagttcgtcgtcacgaatgttcgggttcactgcacgcagagcttccagacgagacagctcggcagacagtttttcgtcggcttcgttacgcgctgcatcaatcaatgcacgggcagatttctcgatctgcgcttcacccagttgaaggatagcgtgaacatcctgctgcacggcgttaaccagtttgctgccggtgtgacggttaaccgcgttaagctggcggttaaaggtttcaaactctacctgcgccgccaggttgttgccgtttttatccagcagcatacgtaccggcgtcggtggcaggaagcggttgagctgcaactgcttcggagcctgggcttcaaccacataaatcagttccaccaacagcgtacctaccggcaacgctttgttttttaacagtgaaatcgtgctgctaccggtatcgccagaaaggatcagatccagaccgttgcggatcagcggatgctcccaggtaataaactgtgcatcttcacgcgccagcgccacttcacgatcaaaggtgatggtgatgccatcttccgacaggccagggaagtccggcaccagcatatgatcggacggcgtcagcacgatcatgttgtcgccgcgatcgtcctgattgataccgataatatcgaacaggttcatggcgaaggcgatcaggttggtatcgtcatcctgctcttcaatgctttctgccagtgcctgggctttttcgccaccgttggagtggatttccagcaggcggtcacgaccctgttccagctgtgctttcagcgcttcatgttgctcgcggcagtttttgatcagatcgtcaaagccttcggtttgatccggtgaagccagatagttaatcagatcgttgtatacgctatcgtaaatagtgcgtccggtcgggcaggtgtgctcaaatgcatccagaccttcgtgataccagcgcaccagcaccgactgagcggttttctccagataaggcacatggatctgaatatcgtgcgcctggccgatacgatccagacgaccaatacgctgctccagtagatccgggttgaatggcaggtcaaacatcaccatgtggctggcgaactggaagttacgtccttcagaaccgatttctgagcacagcagtacctgtgcgccggtgtcttcttcggcaaaccaggcggcagcgcggtcacgttcgataatcgacataccttcgtggaacaccgcagcgcgaataccttcacgttcgcgcagtacctgctccagttgcagcgcagtggcagctttggcgcagatcaccagcactttctgagagcgatggctggtcaggtagcccatcagccactcaacgcgcggatcgaagttccaccaggtggcgttatcaccttcaaattcctgataaatacgctccgggtagagcatatcgcgagcacgatcttccgcacttttacgtgcgcccataatgccggagactttaatagccgtctgatactgcgtcggtagcggcagcttaatggtgtgcagctcgcgtttcgggaatcctttcacaccgttacgcgtgttacggaacagcacgcggctggtgccgtggcgatccatcagcatcgaaaccagctcctgacgggcgctctgggcatcttcgctgtcgctgtttgctgcctgcaacagcggctcgatatcctgctcgccgatcatctcgccgagcatgttcagttcgtcattgctcagtttgttacctgccagcagcatggcaacggcgtccgcaaccggacgataatttttctgctcttcaacgaactgcgcaaaatcgtggaaacggttcgggtccagcagacgcagacgggcgaagtggctttccatccccagctgttccggggtcgcggtcagcagcagaacgcccggcacgtgctctgccagttgttcaatggcctgatattcacggcttggcgcatcttcgctccacaccaggtgatgcgcttcatcgaccaccagcaggtcccattcggcttcacagagatgttccaggcgctgtttgctacgacgggcaaaatccagcgagcaaatcaccagctgttcggtgtcaaacgggttgtaagcatcgtgctgagcttcggcataacgctcatcatcaaatagcgcaaagcgcaggttgaaacggcgcagcatttctaccagccactgatgctgtaaggtttccgggacgataattagcacacgttcagcagcgccagagagcagttgctgatgcaggatcatcccggcttcaatggttttccctaaacccacttcgtcagccagcaggacgcgcggcgcgtggcggcgaccaacatcatgagcgatgttgagctgatgcgggatcaggctggtacgctgaccgcgcaggccgctgtacggcatacggaactgttcgctggaatatttacgcgcgcgataacgcagcgcaaagcggtccatacggtcaatctgcccggcaaacagacggtcctgcggtttgctgaacaccagtttgctatcaaggaaaacttcacgcagggctacgccggactcttcagtatccaggcgagtaccgatataggtcagcaagccattttcttcttttacttcttcgacttgcatctgccagccgtcatggctggtaatggtatcaccagggttgaacatcacgcgggtcacgggggaatcactgcgtgcgtacagacggttttcaccagtagatgggaaaagtaaagtgacagttcgcgcatccaccgcgacaacggttccaagtcccaattcgctttctgtatcgctgatccagcgttgaccaagtgtaaaaggcatatgtgttcggctctatatctttaattgcaggcaataaccacccgctaccgtgcttatgaggtagtggtgttattcaggtccaggaatggaaagggcgctatggtactggatggcaaagcattcgtcacgcatcaaaatggtatctggcgaactcttttttttgctcaaaatagcccaagttgcccggtcataagtgtagcaaaattatcctcaataaaagggagtattccctccgccacgggttgtagctggcgggtcagatagtgttcgtaatccagtggtgaacgttggtagtccagcggctccgggccgttggtggtccatacgtacttaatggtgccgcgattctgatattgcaaggggcgaccacgcttttggttttcttcatcggcaaggcgagcggcgcgtacatgaggcggcacattacgctgatactcgctcagcggacggcgaaggcgtttacggtaaaccagtcgcgcatccagttcacccgccatcagtttgtcgatggtttcgcgtacatattcctgatatggctcgttgcggaagatgcgcaggtatagctcctgctgaaactgctgggccagcggcgtccagtcggtgcgcacggtttccagccctttaaacaccatccgctgcttgtcgccctcctgaatcagtccggcataacgctttttactgccggtatcggctccgcgaatggttggcatcagaaaacggcagaaatgggtttcatactccagttctaatgcgctggtcagccgttgtttttgcagcgtttccgcccaccaggcgttaacgtgctgcaccagtgcacgaccgattttcgccgcttcttcttccgaatgtgcgcctttcagccagacaaacgttgagtcggtatcgccgtagataacgtcgtagccctgtgcttcaatcaacgctttggtttgccgcatgatctgatgaccacgcatggtgatcgacgatgccagccgcggatcgaagaagcggcaggcggtggtgccgagcacgccataaaaggcattcatgatgattttcagcgcctgcgacagcggtttgttaccctggcgtttggcttcatcgcgcccgtgccagatgttagtcacaatctccggcaggcaatgtttttctcgcgagaaccaggcatcgagaaaaccttcggtactgtgctctggatcaggctgcgccatgccttccaccagcccgacgggatcaatcagaaaggtgcggatgatcgacgggtacaggcttttatagtccagcaccagcactgaatcataaagccctggccgtgaatccatcacgtagccgccagggctggcgtgcggcggcacttcgccgagattaggcgcgacataaccagcgcgatgcattcgcggaaaatagagatgaccaaatgccgccaccgaaccgccgtgtcggtccaccggcaggccgttcaccgttgcccgttcgagtaaaaatggcatgatttcagttttgtggaagatctgcgtcaccagctcgcaatctttcaggttataagttgccagcgcaggtttatcttcggcgaaacggcggtcaatttcgtccattcgatcccacgggttatcgatagattttccttcgcctaatagctcctgagcgacagtttccagcgagaatgaagagaaattccagaacgcggatttcagcgcctcgataccgtcgataattagccgacctttagcctgggcaaaaaagacgccgtttttaaagccgtgctcgcgccactccagctcgctattatcgcgcccaagacgcagcggaagacggtaacgctcggcatgtttttgcagcattcgcagatcgaactgcaccacgttccaaccgatgatcacatcaggatcgtagttggcaaaccaggcgttgagtttttccagcaactgcgggcggctggcgacgtattccagttcgaaatcaagcgaggaggcgtcgccattctccggccccagcatataaacgatgcgctgcccgcagccttccaggccgatgcagtacagctcaccgtggcgggtggtttcaatatctatagaaacccacttgagcggcggacgatagtcgggatgcggtttcagacgggcattaacgatagtgccattgtgcatatcaccctcgacccacaccggtgaggtgataaaccgctccatcagatagcgttctggcggacgcacatcggcctcgtagacggtaacgccaccttcacgcaggcgcttttcgtaattcatcaattggcgatgggcgcgacagtaaaggccatacaccggctggcggtgaaaatcctttaacgccagcggtgtcaggcgaaagccttgttcaccctgcaaaatatgctgagcgcggggaacctgatcggcgggaataaacgccacggactcttgcggtgcaagcgtaacctgcaacggcccgttgtccgtcgccagccagaaggagacttctgtcccttgcggggtgtcccgccagtgtcgggttaagataaaacctgcctgcgccacgctgaaaatccatcaaaaaaccaggcttgagtatagcctggtttcgtttgattggctgtggttttatacagtcattactgcccgtaatatgccttcgcgccatgcttacgcagatagtgtttatccagcagcgtttgctgcatatccggtaactgcggcgctaactgacggcagaatatccccatataagcgacctcttccagcacgatggcgttatgcaccgcatcttcggcatttttgccccatgcaaacgggccgtgggaatggaccagaacgccgggcatttgcgctgcatcgataccctgtttttcaaaggtttctacgatgacgttaccggtttcccactcatattcgccgttgatttctgcgtcggtcattttgcgggtgcagggaatggtgccgtagaaatagtcggcgtgggtggtgccggttgctggaatcgactgacccgcctgcgcccagatggtggcgtggcgcgagtgcgtatgcacaatgccgccaatggaggggaatgcctgatagagcagccggtgagttggcgtgtcggaggagggctttttcgtaccttcaaccacttcaccggtttcgatgctaaccacgaccatatcgtcagcggtcatgacgctgtaatcgacgccggaaggtttgatcacaaagacgccgcgctcgcgatcaacggcgctgacgttgccccatgtgagcgtgaccaggttgtgttttggcagcgccaggttggcttctaatacctggcgtttgagatcttctaacatgttgactccttcgtgccggatgcgctttgcttatccggcctacaaaatcgcagcgtgtaggcctgataagacgcgccagcgtcgcatcaggcgttgaatgccggatgcgctttgcttatccggcctacaaaatcgcagcgcgtaggcctgataagacgcgccagcgtcgcatcaggcgttgaatgccggatgcgctttgcttatccggcctacaaaatcgcagcgtgtaggccagataagacgcgtcagcgtcgcatcaggcgttacataccggatgcggctacttagcgacgaaacccgtaatacacttcgttccagcgcagcgcgtctttaaacgctggcaggcgtgtgtcgttatcaatcaccgtgatttcaatgtcgtgcatctcggcgaattggcgcatatcgttgaggttcagtgcatggctgaagacggtatggtgcgcgccaccagcgaggatccacgcttcggaagcagttggcagatccggttgcgctttccacagcgcattcgccaccggcagtttcggcagggagtgcggtgttttcaccgtgtcgatgcagttaaccagtagacggtaacgatcgccgagatcaatcaagctggcgacaatcgctgggccggtttgggtattgaagatcaggcgggcaggatcgtccttaccaccaataccgagatgctgaacgtcgaggatcggtttctcttctgcggcgatcgacgggcagacttccagcatatgggagccgagcaccaggtcattacctttctcgaagtgataggtgtagtcctccataaaggaggtgccgccctgcagaccggttgacatcaccttcatgatgcgaagcagggcggcagttttccagtcgccttcgcccgcaaagccgtaaccctgctgcatcagacgctgtacggccagaccaggaagctgtttcagaccgtgcaaatcttcaaaggtggtggtgaacgcgtggaagccaccttgttccaggaaacgcttcatccccagctcaatacgcgccgcttccagcacgttctgtcgttttttgccgtggatttgtgtggcaggcgtcatggtgtagcagctttcgtactcatcgaccagcgcgttaacatcgccgtcgctgatggagttcaccacctgcaccagatcgccaaccgcccaggtattgacggagaaaccgaacttgatctgtgcggcaactttatcgccatcggtgaccgccacttcacgcatgttatcgccaaatcggcagactttcagatgacgggtatcctgtttagagaccgcctgacgcatccaggagccgatacgctcatgggcttgtttatcctgccagtgaccggtaaccacggcatgttgctgacgcatacgcgcgccaatgaagccgaactcgcgaccgccatgtgcagtctggttcaggttcataaagtccatatcgatactgtcccacggcagcgccgcgttgaactgggtgtggaattgcagcaacggtttgttgagcatggtcaggccgttgatccacattttggccggggagaaggtgtgcagccacaccaccagaccagcgcaacgatcgtcgtaattcgcgtcgcggcaaatagcggtgatttcatccggcgtggtgcccagcggtttcaacaccagtttgcagggcagtttcgcttccgtattcagcgcattaacgacgtgctcggcatgttgggtgacctgacgcagggtttccgggccatacagatgctggctgccaatgacaaaccacacttcataattatcaaaaatcgtcattatcgtgtccttatagagtcgcaacggcctgggcagcctgtgccggggcggaagttggaagatagtgttgttcggcgctcatcgcccattgctgatagcggcgataaagctgttcaaagcgttgtgcctgctcgctgcacggttgcagggttttctctaccgcactggccattttttgctgagctgatgggatgtctgcgtgcactttcgcggcgacggcagcaaaaatcgccgcaccgagcgcacagcactggtcagaggcaacaatttgcagcgggcgattcagcacgtcgcagcaggcctgcataatgacctggtttttccgcgcgatgccgcccagtgccatcacgttattaacggcgatcccctgatcggtaaagcactccatgattgcgcgtgcgccaaaggcggtggcagcaatcaaaccgccgaacagcagcggagcgtcggtagcgaggttaagatcggtaatcacccctttcaggcgttggttagcgttcggtgtgcggcggccgttaaaccagtcgagcaccaccggcaggtgatccagagacggatttttggcccatgcttcggtcagcgccggaagcagttgtttctggctggcgttgatttgcgttttcagttccggatgctgggcggcaagctgttccagcggccagccgagtacgcgaccaaaccaggcgtagatatcaccaaacgccgattggcctgcttccagaccgataaatccaggcaccacgctgccatcaacctgaccgcaaatacctttaactgcccgctcgccaacgctctgtttgtcggcaatcagaatgtcgcaggtggaagtaccgataacttttaccagtgcgttaggctgtgcgcctgcgccaactgcgcccatatggcagtcaaacgcgccgccggaaatcaccacgctttcaggcaggccgagacgctgcgcccattccgggcataaggtgcccaccggaatatcggcagtccaagtgtcagtgaacagcggggaaggcaaatggcgattgaggatcgggtccagctcatcaaagaaactggctggcggcaggccgccccagctttcgtgccacagagatttatgcccggcgctgcaacgtccgcgacgaatatcctgcgggcgggtggtaccggaaagcagagctggcacccagtcgcacagctcaatccacgatgcggcagattgcgccacggcgctgtcctggcgagtcacatgcaggatttttgcccagaaccattcgctggaataaataccaccaatgtagcgggagtagtcaacgttgcccggcgcgtggcacaaacgggtaatctcttccgcttcttcaaccgcagtgtggtctttccacaatacgaacatcgcgttcgggttttcggcaaactccgggcgcagcgccagcacgtttccgtcggcatcaatcggtgcgggcgtcgagccggtactgtcaacgccaatcccgaccacagctgcgcgctgttcgacgctaagctctgcaagcacggttttcagtgccgcttccattgactcaatgtagtcacgcggatgatgacggaactggttattcggggcatcacaaaattgccctttctgccaacggggataccactctacgctggtggcgatctcttcaccggtagcgcagtccaccgccaaagctcgcacagaatcactgccaaaatcgaggccaattgcaatcgccatcgtttcactccatccaaaaaaacgggtatggagaaacagtagagagttgcgataaaaagcgtcaggtaggatccgctaatcttatggataaaaatgctatggcatagcaaagtgtgacgccgtgcaaataatcaatgtggacttttctgccgtgattatagacacttttgttacgcgtttttgtcatggctttggtcccgctttgttacagaatgcttttaataagcggggttaccggttgggttagcgagaagagccagtaaaagacgcagtgacggcaatgtctgatgcaatatggacaattggtttcttctctgaatggtgggagtatgaaaagtatggctgaagcgcaaaatgatcccctgctgccgggatactcgtttaacgcccatctggtggcgggtttaacgccgattgaggccaacggttatctcgatttttttatcgaccgaccgctgggaatgaaaggttatattctcaatctcaccattcgcggtcagggggtggtgaaaaatcagggacgagaatttgtctgccgaccgggtgatattttgctgttcccgccaggagagattcatcactacggtcgtcatccggaggctcgcgaatggtatcaccagtgggtttactttcgtccgcgcgcctactggcatgaatggcttaactggccgtcaatatttgccaatacgggtttctttcgcccggatgaagcgcaccagccgcatttcagcgacctgtttgggcaaatcattaacgccgggcaaggggaagggcgctattcggagctgctggcgataaatctgcttgagcaattgttactgcggcgcatggaagcgattaacgagtcgctccatccaccgatggataatcgggtacgcgaggcttgtcagtacatcagcgatcacctggcagacagcaattttgatatcgccagcgtcgcacagcatgtttgcttgtcgccgtcgcgtctgtcacatcttttccgccagcagttagggattagcgtcttaagctggcgcgaggaccaacgcattagtcaggcgaagctgcttttgagcactacccggatgcctatcgccaccgtcggtcgcaatgttggttttgacgatcaactctatttctcgcgagtatttaaaaaatgcaccggggccagcccgagcgagtttcgtgccggttgtgaagaaaaagtgaatgatgtagccgtcaagttgtcataattggtaacgaatcagacaattgacggcttgacggagtagcatagggtttgcagaatccctgcttcgtccatttgacaggcacattatgcaagcattgctggaacactttattacccaatccaccgtgtattcattgatggcggtggtgttggtggcctttctggagtcgctggcgctggtcggtttgattctacccggtacggtgctgatggcggggctgggagcgctgattggcagcggcgagttaagtttctggcacgcctggctggcagggattattggctgcttgatgggcgactggatttctttctggctgggttggcgttttaaaaagccgttgcatcgctggtcatttctgaagaaaaacaaagcactacttgataaaactgaacatgcgttgcatcaacacagcatgttcaccattctggtcggtcgttttgttggcccgacgcgtccgctggtgccaatggtggcgggaatgctggatctgccggtggctaaatttattacgccgaatattatcggctgcctgctgtggccgccgttttacttcctgccagggattctggcgggcgcggcgatcgatattcctgccggaatgcagagcggtgagtttaaatggttgctgctggcaacagcggtgtttttgtgggttggtggctggctgtgctggcggttatggcgcagcggtaaagcgactgaccgtttgagtcattatttgtcccgcggtcgtttgttgtggctgacgccgttgatttctgccatcggcgtggtggcgctggtggtgttaattcgccacccgttgatgccggtgtatatcgatattttgcgtaaagtggttggggtttaggagatagtcttgtgcgggttgcctgatgcgacgcttgccgcgtcttatcaggcctacaaaacgcactacccgtaggtcggataaggcgttcacgccgcatccgacagtgcatactaacccgtaatccccaatagtgccgaagcactcgccttaccgctcaacaactcattggtcataccctgccaggcgatgcgcccgtcggcgactactaccgagcgcgtggcgatccgcgccgcatcttccacgctgtgcgacaccatcaatagcgtcattttttgctgctggcagctcgtgctcaccagcgtcaacatctcctgacgtaacgccggatcgagcgcagagaacggttcatcgagcaataaaatcggctgttcgcgtaccagacaacgcgctaacgccactcgctgtcgctgaccgccggaaagctcgcccggtaaccgcgccattaaattatcaatccccatctggcgggcgatagcgtgcattttcccctgctgtaccgcgttcagtttcaatcccggatttagccccagcccgatgttctgtgcgaccgtcaggtggctgaacaggttgttctcctgaaacagcatcgacaccggacggcgtgacggcggcatagttgtgtgatctacgccatcgatagtcagcgaaccgctggctggcgtcagaaaaccggcgatcaaattcagcagggtacttttacccgcgccgcttggcccgaggatcgccacctgctcgccgcgttccaccgttaagctaaaacgcatcggcaaatggtggtaaagccaggtgatatcagtcagttttaacatttcgccccggtagtttttcaatcacggtaaacagcagaaaacagagcagcagcagaattaacgcggtgaccgcaccgtcctggctgcgataggagccaatttgctggtagagataaaacggcagggtgcggaaatcatcgttaccgaacaacgccaccacgccaaaatcaccaatcgacagcacgcatgcaaaggccagcgcctgcgccagtggacgtttcagggcgcgcagctccaccacttttaagcgtgaccagccttcaatccccagcgactgacataacatgctgtagcgggcggtgatatcgcgcatcgggttttccagcactttcagcgcataagggatcgccattaacgcattggtgaaaatcacaatgccgtcagcagattgtggcaggccgatagtgttgttgagcagtaaaaagaagccggtagccagcacaatccccggcatggcgaggatcaacatgccgctcatctccagcacctgacccgccagcattttctgccgcgcccgcagttcgcgactgctccatagcagcatcatggtcagcactacgcacaatacacctgccgccagcgcaatacgcaacgaggtccacagcgcctgccacagcaccggttgtgccagcacttccggcaactggcgatttaccccatcgacgatcaccgccagtaacggtggcagcaacagcagcagcgccagcacaattaacaccgtgtcgcaaatgcggctatgcagacgatcgtccgggtcgcgccagccttgcagcagcgtggtgccgggcgcaatggccttactcaatcgctgactcaacagcaccagcccgaggcagcacaccatctggagcagcgccagcattgccgcgcgggcaggatcgtagtcgtaactcagcgcctgatagattgccagctcgatagtggtcgcctgcggaccgccccccagcgatagcacggtggcgaagctggcgaaacagagcataaagataagcgcagcaaccggcgggatttgtcgccgtaaccacggccattcgacgaagcggaaaaaatgccagctacgcatcccaagctgggcggcaagttgacgctgttcgccggggatgttttccagtgcctggagtaataagcggctcgccatcggcagattaaaaaacacatgggccagcaaaataccttgcaggccgtagggcgaaaaggtccactccagaccgagcgattggcagagtgttgccagccagccctggcgaccatagacgctaagaatgccgaaaacagcgaccaacaccgggaggatcaaggtcattgcacacagacgcaacagcgccagccgacccggaaagcgcctgcgatagagcgcgcgggcgaggaatatcgcgggtatgacagagagcagtgccgagagaaacgcctgccagaaggagaagcgcaccacatgccacagatagctgtcctgccagactgccacccagtcatcctgcggcgcgttccaccacagggcgagaaacgccgccagcgcaaccgctaccaccagcgtggtggcgcttacacctggaattaaccagccgggaattaacggctgacggcgcgttgccattcgctaatccatgcctgacgttgtgccgccacttcggctggcgtgaactccaacgtggttgcgggtttggtcaatttttcaaaaccggcaggcagcgtgacgtttgccaccggatacatccagttgccggttgggatcgcattctggaaagccggagaaaccataaactggaggaatttttgcgccagctccggctgcttgctggcagcggtgcgggcggcgacttccacttgcagatagtgaccttcgctgaagttcgcggcggcgtagttatctttcttctcttcgagaatgtgataagccggagaggtggtgtaactcagtaccagatcgctttcaccttttaaaaacaggccgtaggcttcgctccagcctttggtgaccgtgaccgttttcttcgccagtttctgccaggcttgtggggcgtcatcgccatagactttttgcatccatagcaacagacccagccccggtgtactggtgcgcggatcctgataaatcacccgccagttttgatcgctctcaaccagttctttcaggctttgtggcgggtttttcagtttgttcttgtcataaacgaaggcgaagtagccataatcaaacggtacgaaagtgtcattattccagccgccgggaacgttaacggcatccgctgccacaccgcttttggcaaacagtccggttttactggcggcgtctaacaggttgttatccagccccagcaccacatcggctttactgtttttgccttccatccgtagacggttgagaagcgaaacgccatcttccagcgccaccagtttcagttcgcaattacagtcggcttcaaaggcttttttaaccaccggaccaggcccccagtcggcggcgaaggaatcgtaggtataaacagtcagaacgggtttagcgaaaacgggcgctgtgcacagcaacagcaggggcagacatttttttaacactttgcacctcaaaaaagagtggcaaaggacttgagaaggagcctcaaatcccttcgccggcgttatccggatcaggttcgacgggtattttctcagcgcacgcgtacgcgtggcaccccgttgagaacggcgttagtgtagtgattttgttatcaaccagcaatcatggatccggtggcgcaaaccacgctgatttaaaatcgaaccagccgagggtattcatgcgcaggccgcgcatactgcgttgcccctgaatgatcagccagtggtgcaataatggcaccatcgctttgctggcgaccagttgctggcaccagttcgccagattcatctcgccattgcgccagcgagcagcgtcggcttgccagtcaatgggaatgcaatgttgtagcagtggcacttcgcataaatgtgcgaaaacagagaagtccagcggcagggtaaagttggcgctgtttagccagatatcactttcgatctctcctgtatgccactgatcgtagtcgatctctttgattttcagcgtgacctggtgacttgccagaatctgctgcatgatcccggcaatcacccgatgctcactgtgatcctgataaaaggttagggtgaggctttccaggccagccggtttttcgctctttatggtgcgggcatggtgccaacgggggagcagtccataagccgggaaccacagttgctggtactgttcctcagcgaaatagaccagattagttggagaaagcacatagcttacccagtccctgacttgctgattcgccccgcgatgggtgcggctgtcgaacagtaaatagtagcaaccttcctccaggcggctttcaatctctttttcctcgccctgtggaccttttagcatcagccctccggctggctcgtcggcaatttccggcagaacccagacgttaacttcgtcgattaatgcccggtaaccgaagaagtcatcgaatgcctgaattttcagttgattggtgctgttgcgaatcaccgcatacggaccggtgccgatgggatggctggcaaagttactgagggtttcccattcgcgcggcaggatcatcgccggaacttgccccagcagtaacggtaaccagcggtccggttgcgtgagatggatatccagcgtccagggcgtcggcgacacaatgtcagcaatatgcgaatagagcggcagcgtattgattcgttttaaagaggcgatcacatcgtccatttccagttcacgaccatggtgaaaatggactcctggacgcaaaaagaaacgccagtgaagcggtgaaatttgctgccagtggtgggcgatgtctgcttccagttccccattttcctcatttatgcgcgttagcgaactgaagatttgccgggcgatatgggtttcggaacggcgcaatgcgctgccaggtagcagattacgcaacggacgatagtagagcacgcgcaggatgtgccgcccctggcggaagctgcggcccagatgagaaaccagcatttgccgcacagtcgctttgtcgccaaccaactgcaccagttgatcgatacgatcctgctccagcaggtcttccgcccgctgttgctgaagcgccagcccggtatagaggaatgtcagacgcgagcgtttaccgcgcccgacttccgcttcccacgtcagccagccgcgatcctgcatggtgttgagcagggtgcgcatatgacgacgcgagcagctcaataacgctgccagttcgttgagcgttgtgtcctgcgatttaccctcgcagcattgccacaggcggatgaactgttgttgcagacgagcagatggcataaaaggggaactcctgtgcaaaagacagcaattttattttccctatattaagtcaataattcctaacgatgaagcaagggggtgccccatgcgtcagttttatcagcactattttaccgcgacagcgaagttgtgctggttgcgttggttaagcgtcccacaacgattaaccatgcttgaaggactgatgcagtgggatgaccgcaattctgaaagttgacttgcctgcatcatgtgtgactgagtattggtgtaaaatcacccgccagcagattatacctgctggttttttttattctcgccgcgctaaaaagggaacgtatgatctggataatgacgatggctcgccgtatgaacggtgtttacgcggcatttatgctggtcgcttttatgatgggggtggccggggcgctacaggctcctacattgagcttatttctgagtcgtgaggttggcgcgcaacctttctggatcggcctcttttatacggtgaatgctattgctgggatcggcgtaagcctctggttggcaaaacgttctgacagtcagggcgatcggcgaaaactgattatattttgctgtttgatggctatcggcaatgcgctattgtttgcatttaatcgtcattatctgacgcttatcacctgtggtgtgcttctggcatctctggccaatacggcaatgccacagttatttgctctggcgcgggaatatgcggataactcggcgcgagaagtggtgatgtttagctcggtgatgcgtgcgcagctttctctggcatgggttatcggtccaccgttggcctttatgctggcgttgaattacggctttacggtgatgttttcgattgccgccgggatattcacactcagtctggtattgattgcatttatgcttccgtctgtggcgcgggtagaactgccgtcggaaaatgctttatcaatgcaaggtggctggcaggatagtaacgtacggatgttatttgtcgcctcgacgttaatgtggacctgcaacaccatgtacattattgatatgccgttgtggatcagtagcgagttaggattgccagacaaactggcgggtttcctgatggggacggcagctggactggaaataccagcaatgattctggctggctactatgtcaaacgttatggtaagcggcgaatgatggtcatagcagtggcggcaggagtactgttttacaccggattgattttctttaatagccgtatggcgttgatgacgctgcaactttttaacgctgtatttatcggcattgttgcgggtattgggatgctatggtttcaggatttaatgcctggaagagcgggggcagctaccaccttatttactaacagtatttctaccggggtaattctggctggcgttattcagggagcaattgcacaaagttgggggcactttgctgtctactgggtaattgcggttatttctgttgtcgcattatttttaaccgcaaaggttaaagacgtttgatgacgtggacgatagcggaaagcccggtcatttgaccgggcaaggggattaattcataaacgcaggttgttttgcttcataagcggcaatggcgtcgtcgtgctgcaaggtaagcccaatactgtccagaccgttcatcatgcagtggcggcggaaggcatcgatggtaaagcgataggttttctctcccgctttcacctcttgcgcttccagatccacgtcgaaatggatccccggattagctttcaccagcgcaaacagttcgtccacttctgcatcgcttaatttcaccggcagcagctggttgttaaagctattgccgtagaagatgtcagcaaaactcggcgcaatcaccactttaaaaccgtagtcggtcaatgcccagggcgcgtgctcacgcgaagagccacagccgaagttttctcgtgccagcaaaatggaagcgccctgatactgcgggaagttcagcacgaagtccgggtttggctgttggcctttttcatccagaaaacgccagtcgttaaacagatgcgcgccaaaacccgtacgggtcactttctgcaaaaactgtttcgggatgattgcatcggtatcgacattggcggcatccagcggaaccaccaggcctgtgtgtttgataaatttctctgccatggtgtgctccttatttaatgttgcgaatgtcggcgaaatgtccggtcacagcagcagcggcagccattgccgggctgaccagatgcgtgcgcccgccgcgcccctggcggccttcaaagttacggttgctggtggaggcacaacgttcgcccggattcagacggtcgttgttcatcgccagacacattgagcagccaggcaagcgccattcaaaaccggcttcaataaagattttatccagaccttccgcttccgcctgggcttttaccgggccagagccgggaaccaccagtgcctgcacgcctggcgcgacttttcgccctttggcgatctccgctgccgcgcgtaaatcttcaatgcgcgagttggtacaggaaccgataaacactttgtcgatagccacttcggtcagcggaatacccggtttcagccccatataggccagcgctttttctgccgacgcgcgttcaaccggatcggcaaacgaagccggatcgggaatattgtcgttcacggaaatcacctggccgggattggtgccccaggtgacctgcggtgaaatttcttctgcttgcagagtgacaacggtatcgaaagttgcgccttcgtcggtttgcagggttttccagtaggcaacggcgtcgtcgaaatctttgcctttcggcgcatgcagacggcctttgacatagttaaaggtggtttcgtccggtgcaaccagaccggcttttgcgcccatttcgattgccatattgcacagggtcatacgaccttccatgcttaaatcacggattgcttcgccgcaaaactccaccacatgcccggtgccgcctgcgctaccggttttaccgataattgccagcacgatatcttttgcggtaatgcccggcgcggctttgccctggacttcaattttcatggtttttgcgcggccctgtttcagggtttgcgttgccagtacgtgttcaacttcggaagtgccgataccaaaggccagtgcgccaaacgcgccgtgggtggcggtatgcgagtcgccgcagacaatggtcatccccggcaaggtgacgccctgttccggccccattacgtggacgatcccctgatacgggtgattcaggtcatacagttcgacgccaaattctttgcagtttttgatcagttcctgcatctggatacgcgccatttcaccgcaggcattaatgtctttggtctgggtagagacgttgtgatccatggtagcgaaggttttgcccggctgacgtaccgggcgaccgtgggcgcgcagaccatcgaacgcctgcggtgaggtcacttcatgcaccaggtggcggtcgatatataacagtggggtttcgttttcggcttcgtacacaacgtgagcgtcgaacaatttttcgtataacgtcttagccatgattacaccccttctgctacatagcgggcaatgatatcgcccatttcatcggtactaacggcggcagcgccacgggctaaatccccggtgcgaatgccttcttctaatgcgcggttaatggcgcgttcaatggcgcaagccgcatcatcggcatccaggctgtaacgcagcagcagtgccagcgaaaggatttgtgcaatcgggttggcgatgtttttgcctgcgatatctggtgccgagccgcccgccggttcatacagtccaaaaccttgctcgttcaggctggcggaaggcaacatccccatcgagccagtgatcattgcgcactcgtcagacagaatgtcgccaaacaggttggagcacagcagaacgtcaaactgtgatggatctttaatcagctgcatggtggcgttgtcgatgtacatatgcgccagttcgacatccgggtattccgtggcgatctcgttaacgatctcccgccataaaatagaggattgcagcacgttggctttatcgatcgacgtcactttgtggcgacgcttgcgagcagattcaaacgcgatgcgggcgatacgttcgatctcaaaacggtgatacacctcggtatcaaaggctttttcatattgtccgctaccttcgcggccttttggctgaccgaaatagatgccgccggtcagttcgcgcacacacaggatgtcgaagccgtttgcggcaatgtctgcacgcagcggacagaatgcttccagcccctgatacagttttgccgggcgcaggttgctgaataatttgaagtgcttacgcagaggcagcagcgcgccgcgttctggttgctggtctggtggtaaatgttcccacttcgggccgcctaccgagccaaacagcacggcatcggcttgctcacaaccttcaaccgtcgcaggcggcagtggttgcccgtggttatcaatggctgcgccgcctacatcgtaatggctggtggtgatgcgcatcgcaaagcggttgcgcacggcatccagcactttcagcgcctgggtcatcacttccggaccaataccgtcccccggcaatacggcaatatggtaattcttcgacatcacacggtttccttgttgttttcgttgtgttgagctttgcgttgcaactctttttcgacttctgcggcacgccagatattgttcagaacgtgcaccatggctttggcagatgactcgacaatatcggtagccaggccgacgccgtggaagcggcgaccgttgtagttagcgacgatatccacctgacccagcgcatctttaccgtggcctttggcggtcaggctgtatttcaccagttcgacgttatattcagtgatgcggttaattgcctgatagacggcatcgaccggaccgttaccgttggcggcttctgctttgacttcttcgccacaggccagtttgacggcggcggtggcgatatcgttagagccagactgcacgctgaagtaatccagacggaaatgctccggctcttcttgctgcttaccgatgaaggccagcgcctccagatcgtaatcaaacacctgaccttttttgtccgccagcttcaggaaagcatcgtacaaattgtctaaattatattcactttctttataccccatctcatccatgcgatgtttcaccgccgcacgccccgaacgagaggtcagattcagctggatttggttcagaccaatagattctggtgtcatgatttcgtagttttcgcggtttttcagcacgccatcctggtgtataccggaggagtgtgcgaatgcgccgctgccaacaatggctttgtttgccgggatcggcatattacaaatctggctaactaactggctggtgcgccatatctcctggtgattaatggcggtgtggacgttgagaatatccttacgaactttgatcgccatgatgacttcttccagggaacagtttccggcacgctcgccgatcccgttcattgcgccttccacctggcgtgcaccggcatgtaccgccgccagtgagtttccgaccgccaggcccaaatcgtcgtgggtatgtacggagataatggctttgtcgatgttaggcacgcgttcatacaggccgctgatgattccggcgaactcaaacggcatggtgtagcccacggtgtccggaatgttgatggtggtggcaccggcattaatcgccgcttcgaccactcgcgccagatcggcaatgggtgtacgcccggcatcttcgcaagaaaattcaacatcatcggtgtaattacgggcgcgtttcaccatatagatagcgcgttcgatcacctcgtccagcgtgctgcgcagcttggtggcgatgtgcattggcgaagtggcaataaaggtatgaatacggaaggcttcggcgactttcagggattcggccgccacgtcgatatctttttccacgcagcgagctaacgcacatacgcggctgtttttaacctggcgggcgatggtttgcaccgattcaaaatcgcccggcgaagagacggggaaaccgacttccatcacgtcaacacccatacgctcaagggccagcgcaatttgcagtttttctttcacactcaagcttgcctgtaacgcctgttcaccgtcgcgcaatgtggtatcgaaaataatgacttgctggctcatggtttgggtccttgtctcttttagagcgcctcgcttcgggcataaaaaaacccgcgcaatggcgcgggttttttgtttgactgcgtgctggcttaatgctggatgccgctcactcgtctaccgcgcaaagaagatgcgtttagtagtagtagaccgataaagcgaacgatgtgagtcattaaatcagctccagatgaatgcgatatgcttttagagttactggatacaaaaacggatgtcaaccctgacgcaataaaaacgtcccgccagcgtgagttctgcatccgtaaaattagctaattgtgctgcggtggttaaagtaagcgatattaatttctgcttaactaccgacgcttttcatcggttgacatatttcagcataaatttttgcatctaatcaacgaggaaaaaggggacaaaatgcacgcgttgcaaaacctatcctgatgatttgtattgaattatatgttttgcgattttttttgatattgatttggtgaatattattgatcaattaatgttaagaattaatgcattaaatatataaattaattattaaataagcacatttaatccattttgtagatgattgagtattcgcggtagttatgattagattgttttcgcaacaaaaacattatggattattatgctgtggtaaatgactcattccacggcaatggattctgtttttatcagaacccgtatctttatgttttccgaattttactcattttgctttttcttattttatatgcatgataaatcatattcttcaggattatttctctgcattccaataagggaaagggagttaagtgtgacagtggagttaagtatgccagaggtacaaacagatcatccagagacggcggagttaagcaaaccacagctacgcatggtcgatctcaacttattaaccgttttcgatgccgtgatgcaggagcaaaacattactcgtgccgctcatgttctgggaatgtcgcaacctgcggtcagtaacgctgttgcacgcctgaaggtgatgtttaatgacgagctttttgttcgttatggccgtggtattcaaccgactgctcgcgcatttcaactttttggttcagttcgtcaggcattgcaactagtacaaaatgaattgcctggttcaggttttgaacccgcgagcagtgaacgtgtatttcatctttgtgtttgcagcccgttagacagcattctgacctcgcagatttataatcacattgagcagattgcgccaaatatacatgttatgttcaagtcttcattaaatcagaacactgaacatcagctgcgttatcaggaaacggagtttgtgattagttatgaagacttccatcgtcctgaatttaccagcgtaccattatttaaagatgaaatggtgctggtagccagcaaaaatcatccaacaattaagggcccgttactgaaacatgatgtttataacgaacaacatgcggcggtttcgctcgatcgtttcgcgtcatttagtcaaccttggtatgacacggtagataagcaagccagtatcgcgtatcagggcatggcaatgatgagcgtacttagcgtggtgtcgcaaacgcatttggtcgctattgcgccgcgttggctggctgaagagttcgctgaatccttagaattacaggtattaccgctgccgttaaaacaaaacagcagaacctgttatctctcctggcatgaagctgccgggcgcgataaaggccatcagtggatggaagagcaattagtctcaatttgcaaacgctaactgattgcagaataggtcagacatgaatgtctggtttattctgcattttttattgaatgtagaattttattctgaatgtgtgggctctctattttaggattaattaaaaaaatagagaaattgctgtaagttgtgggattcagccgatttattatcaatttaatcctctgtaatggaggattttatcgtttcttttcacctttcctcctgtttattcttattaccccgtgtttatgtctctggctgccaattgcttaagcaagatcggacggttaatgtgttttacacattttttccgtcaaacagtgaggcaggccatggagatgttgtctggagccgagatggtcgtccgatcgcttatcgatcagggcgttaaacaagtattcggttatcccggaggcgcagtccttgatatttatgatgcattgcataccgtgggtggtattgatcatgtattagttcgtcatgagcaggcggcggtgcatatggccgatggcctggcgcgcgcgaccggggaagtcggcgtcgtgctggtaacgtcgggtccaggggcgaccaatgcgattactggcatcgccaccgcttatatggattccattccattagttgtcctttccgggcaggtagcgacctcgttgataggttacgatgcctttcaggagtgcgacatggtggggatttcgcgaccggtggttaaacacagttttctggttaagcaaacggaagacattccgcaggtgctgaaaaaggctttctggctggcggcaagtggtcgcccaggaccagtagtcgttgatttaccgaaagatattcttaatccggcgaacaaattaccctatgtctggccggagtcggtcagtatgcgttcttacaatcccactactaccggacataaagggcaaattaagcgtgctctgcaaacgctggtagcggcaaaaaaaccggttgtctacgtaggcggtggggcaatcacggcgggctgccatcagcagttgaaagaaacggtggaggcgttgaatctgcccgttgtttgctcattgatggggctgggggcgtttccggcaacgcatcgtcaggcactgggcatgctgggaatgcacggtacctacgaagccaatatgacgatgcataacgcggatgtgattttcgccgtcggggtacgatttgatgaccgaacgacgaacaatctggcaaagtactgcccaaatgccactgttctgcatatcgatattgatcctacttccatttctaaaaccgtgactgcggatatcccgattgtgggggatgctcgccaggtcctcgaacaaatgcttgaactcttgtcgcaagaatccgcccatcaaccactggatgagatccgcgactggtggcagcaaattgaacagtggcgcgctcgtcagtgcctgaaatatgacactcacagtgaaaagattaaaccgcaggcggtgatcgagactctttggcggttgacgaagggagacgcttacgtgacgtccgatgtcgggcagcaccagatgtttgctgcactttattatccattcgacaaaccgcgtcgctggatcaattccggtggcctcggcacgatgggttttggtttacctgcggcactgggcgtcaaaatggcgttgccagaagaaaccgtggtttgcgtcactggcgacggcagtattcagatgaacatccaggaactgtctaccgcgttgcaatacgagttgcccgtactggtggtgaatctcaataaccgctatctggggatggtgaagcagtggcaggacatgatctattccggccgtcattcacaatcttatatgcaatcgctacccgatttcgtccgtctggcggaagcctatgggcatgtcgggatccagatttctcatccgcatgagctggaaagcaaacttagcgaggcgctggaacaggtgcgcaataatcgcctggtgtttgttgatgttaccgtcgatggcagcgagcacgtctacccgatgcagattcgcgggggcggaatggatgaaatgtggttaagcaaaacggagagaacctgattatgcgccggatattatcagtcttactcgaaaatgaatcaggcgcgttatcccgcgtgattggccttttttcccagcgtggctacaacattgaaagcctgaccgttgcgccaaccgacgatccgacattatcgcgtatgaccatccagaccgtgggcgatgaaaaagtacttgagcagatcgaaaagcaattacacaaactggtcgatgtcttgcgcgtgagtgagttggggcagggcgcgcatgttgagcgggaaatcatgctggtgaaaattcaggccagcggttacgggcgtgacgaagtgaaacgtaatacggaaatattccgtgggcaaattatcgatgtcacaccctcgctttataccgttcaattagcaggcaccagcggtaagcttgatgcatttttagcatcgattcgcgatgtggcgaaaattgtggaggttgctcgctctggtgtggtcggactttcgcgcggcgataaaataatgcgttgagaatgatctcaatgcgcaatttacagcccaacatgtcacgttgggctttttttgcgaaatcagtgggaacctggaataaaagcagttgccgcagttaattttctgcgcttagatgttaatgaatttaacccataccagtacaatggctatggtttttacattttacgcaaggggcaattgtgaaactggatgaaatcgctcggctggcgggagtgtcgcggaccactgcaagctatgttattaacggcaaagcgaagcaataccgtgtgagcgacaaaaccgttgaaaaagtcatggctgtggtgcgtgagcacaattaccacccgaacgccgtggcagctgggcttcgtgctggacgcacacgttctattggtcttgtgatccccgatctggagaacaccagctatacccgcatcgctaactatcttgaacgccaggcgcggcaacggggttatcaactgctgattgcctgctcagaagatcagccagacaacgaaatgcggtgcattgagcaccttttacagcgtcaggttgatgccattattgtttcgacgtcgttgcctcctgagcatcctttttatcaacgctgggctaacgacccgttcccgattgtcgcgctggaccgcgccctcgatcgtgaacacttcaccagcgtggttggtgccgatcaggatgatgccgaaatgctggcggaagagttacgtaagtttcccgccgagacggtgctttatcttggtgcgctaccggagctttctgtcagcttcctgcgtgaacaaggtttccgtactgcctggaaagatgatccgcgcgaagtgcatttcctgtatgccaacagctatgagcgggaggcggctgcccagttattcgaaaaatggctggaaacgcatccgatgccgcaggcgctgttcacaacgtcgtttgcgttgttgcaaggagtgatggatgtcacgctgcgtcgcgacggcaaactgccttctgacctggcaattgccacctttggcgataacgaactgctcgacttcttacagtgtccggtgctggcagtggctcaacgtcaccgcgatgtcgcagagcgtgtgctggagattgtcctggcaagcctggacgaaccgcgtaagccaaaacctggtttaacgcgcattaaacgtaatctctatcgccgcggcgtgctcagccgtagctaagccgcgaacaaaaatacgcgccaggtgaatttccctctggcgcgtagagtacgggactggacatcaatatgcttaaagtaaataagactattcctgactattattgataaatgcttttaaacccgcccgttaattaactcaccagctgaaattcacaataattaagtgatatcgacagcgcgtttttgcattattttgttacatgcggcgatgaattgccgatttaacaaacacttttctttgcttttgcgcaaacccgctggcatcaagcgccacacagacgtaacaaggactgttaaccggggaagatatgtcctaaaatgccgctcgcgtcgcaaactgacactttatatttgctgtggaaaatagtgagtcattttaaaacggtgatgacgatgagggattttttcttacagctattcataacgttaatttgcttcgcacgttggacgtaaaataaacaacgctgatattagccgtaaacatcgggttttttacctcggtatgccttgtgactggcttgacaagcttttcctcagctccgtaaactcctttcagtgggaaattgtggggcaaagtgggaataaggggtgaggctggcatgttccggggagcaacgttagtcaatctcgacagcaaagggcgcttatcagtgcctacccgttatcgggaacagctgcttgagaacgctgccggtcaaatggtttgcaccattgacatttatcacccgtgcctgctgctttaccccctgcctgaatgggaaattatcgagcaaaaattatcgcgtctgtcgagcatgaacccggttgagcgccgtgtgcagcgcctactgttaggtcatgccagcgaatgtcagatggatggcgcaggtcgattgttaatcgcgccagtactgcggcaacatgccgggctgacaaaagaagtgatgctggttggacagttcaacaagtttgagctgtgggatgaaacaacctggcatcaacaggtcaaggaagatatcgacgcagagcagttggctaccggagacttatcggagcgactgcaggacttgtctctataaaatgatggaaaactataaacatactacggtgctgctggatgaagccgttaatggcctcaatatccgtcctgatggcatctacattgatgggacttttggtcgcggtggtcactcacgtctgatcctctcgcagcttggcgaagaggggcgtttgctggcgatcgatcgcgacccgcaggctatcgccgttgcgaagactattgatgatccgcgcttctccatcatccacggacctttctccgcgctgggcgaatacgttgccgagcgcgatcttatcggcaagatcgacggcattctcctcgatcttggcgtctcttcaccgcaacttgatgatgctgaacgtggcttttcctttatgcgcgatggtccgctggacatgcgtatggacccaacccgtgggcagtcagccgctgaatggctacaaaccgcagaagaagccgatatcgcctgggtattgaaaacctatggtgaagagcgttttgccaaacgcattgcccgcgccattgtcgagcgtaaccgcgaacagccgatgacccgcaccaaagaactggcggaagtcgtggctgctgcaacgccggtgaaagataagtttaaacatcccgcgacccgtaccttccaggcggtgcgcatttgggtaaacagtgaactggaggagatagagcaggcgctaaaaagctcgctcaacgtgctggccccgggtgggcggctttcgatcatcagcttccactcgctggaagaccgtattgtgaaacgttttatgcgtgaaaacagccgcggtccgcaagttccggcagggttaccgatgactgaagagcagctcaaaaaactgggtggccgtcagctgcgagcactaggcaagttaatgccgggcgaagaagaggtggctgagaaccctcgtgcccgtagttcagttctgcgtattgcagagaggacgaatgcatgatcagcagagtgacagaagctctaagcaaagttaaaggatcgatgggaagccacgagcgccatgcattgcctggtgttatcggtgacgatcttttgcgatttgggaagctgccactctgcctgttcatttgcattattttgacggcggtgactgtggtaaccacggcgcaccatacccgtttactgaccgctcagcgcgaacaactggtgctggagcgagatgctttagacattgaatggcgcaacctgatccttgaagagaatgcgctcggcgaccatagccgggtggaaaggatcgccacggaaaagctgcaaatgcagcatgttgatccgtcacaagaaaatatcgtagtgcaaaaataaggataaacgcgacgcatgaaagcagcggcgaaaacgcagaaaccaaaacgtcaggaagaacatgccaactttatcagttggcgttttgcgttgttatgcggctgtattctcctggcgctggcttttctgctcggacgcgtagcgtggttacaagttatctccccggatatgctggtgaaagagggcgacatgcgttctcttcgcgttcagcaagtttccacctcccgcggcatgattactgaccgttctggtcgcccgttagcggtgagcgtgccggtaaaagcgatttgggctgacccgaaagaagtgcatgacgctggcggtatcagcgtcggtgaccgctggaaggcgctggctaacgcgctcaatattccgctggatcagctttcagcccgcattaacgccaacccgaaagggcgctttatttatctggcgcgtcaggtgaaccctgacatggcggactacatcaaaaaactgaaactgccggggattcatctgcgtgaagagtctcgccgttactatccgtccggcgaagtgactgctcacctcatcggctttactaacgtcgatagtcaagggattgagggcgttgagaagagtttcgataaatggcttaccgggcagccgggtgagcgcattgtgcgtaaagaccgctatggtcgcgtaattgaagatatttcttctactgacagccaggcagcgcacaacctggcgctgagtattgatgaacgcctgcaggcgctggtttatcgcgaactgaacaacgcggtggcctttaacaaggctgaatctggtagcgccgtgctggtggatgtcaacaccggtgaagtgctggcgatggctaacagcccgtcatacaaccctaacaatctgagcggcacgccgaaagaggcgatgcgtaaccgtaccatcaccgacgtgtttgaaccgggctcaacggttaaaccgatggtggtaatgaccgcgttgcaacgtggcgtggtgcgggaaaactcggtactcaataccattccttatcgaattaacggccacgaaatcaaagacgtggcacgctacagcgaattaaccctgaccggggtattacagaagtcgagtaacgtcggtgtttccaagctggcgttagcgatgccgtcctcagcgttagtagatacttactcacgttttggactgggaaaagcgaccaatttggggttggtcggagaacgcagtggcttatatcctcaaaaacaacggtggtctgacatagagagggccaccttctctttcggctacgggctaatggtaacaccattacagttagcgcgagtctacgcaactatcggcagctacggcatttatcgcccactgtcgattaccaaagttgaccccccggttcccggtgaacgtgtcttcccggaatccattgtccgcactgtggtgcatatgatggaaagcgtggcgctaccaggcggcggcggcgtgaaggcggcgattaaaggctatcgtatcgccattaaaaccggtaccgcgaaaaaggtcgggccggacggtcgctacatcaataaatatattgcttataccgcaggcgttgcgcctgcgagtcagccgcgcttcgcgctggttgttgttatcaacgatccgcaggcgggtaaatactacggcggcgccgtttccgcgccggtctttggtgccatcatgggcggcgtattgcgtaccatgaacatcgagccggatgcgctgacaacgggcgataaaaatgaatttgtgattaatcaaggcgaggggacaggtggcagatcgtaatttgcgcgaccttcttgctccgtgggtgccagacgcaccttcgcgagcactgcgagagatgacactcgacagccgtgtggctgcggcgggcgatctctttgtagctgtagtaggtcatcaggcggacgggcgtcgatatatcccgcaggcgatagcgcaaggtgtggctgccattattgcagaggcgaaagatgaggcgaccgatggtgaaatccgtgaaatgcacggcgtaccggtcatctatctcagccagctcaacgagcgtttatctgcactggcgggccgcttttaccatgaaccctctgacaatttacgtctcgtgggcgtaacgggcaccaacggcaaaaccacgactacccagctgttggcgcagtggagccaactgcttggcgaaatcagcgcggtaatgggcaccgttggtaacggcctgctggggaaagtgatcccgacagaaaatacaaccggttcggcagtcgatgttcagcatgagctggcggggctggtggatcagggcgcgacgttttgcgcaatggaagtttcctcccacgggctggtacagcaccgtgtggcggcattgaaatttgcggcgtcggtctttaccaacttaagccgcgatcaccttgattatcatggtgatatggaacactacgaagccgcgaaatggctgctttattctgagcatcattgcggtcaggcgattattaacgccgacgatgaagtgggccgccgctggctggcaaaactgccggacgcggttgcggtatcaatggaagatcatattaatccgaactgtcacggacgctggttgaaagcgaccgaagtgaactatcacgacagcggtgcgacgattcgctttagctcaagttggggcgatggcgaaattgaaagccatctgatgggcgcttttaacgtcagcaacctgctgctcgcgctggcgacactgttggcactcggctatccactggctgatctgctgaaaaccgccgcgcgtctgcaaccggtttgcggacgtatggaagtgttcactgcgccaggcaaaccgacggtggtggtggattacgcgcatacgccggatgcactggaaaaagccttacaggcggcgcgtctgcactgtgcgggcaagctgtggtgtgtctttggctgtggtggcgatcgcgataaaggtaagcgtccactgatgggcgcaattgccgaagagtttgctgacgtggcggtggtgacggacgataacccgcgtaccgaagaaccgcgtgccatcatcaacgatattctggcgggaatgttagatgccggacatgccaaagtgatggaaggccgtgctgaagcggtgacttgcgccgttatgcaggctaaagagaatgatgtggtactggtcgcgggcaaaggccatgaagattaccagattgttggcaatcagcgtctggactactccgatcgcgtcacggtggcgcgtctgctgggggtgattgcatgattagcgtaacccttagccaacttaccgacattctcaacggtgaactgcaaggtgcagatatcacccttgatgctgtaaccactgatacccgaaaactgacgccgggctgcctgtttgttgccctgaaaggcgaacgttttgatgcccacgattttgccgaccaggcgaaagctggcggcgcaggcgcactactggttagccgtccgctggacatcgacctgccgcagttaatcgtcaaggatacgcgtctggcgtttggtgaactggctgcatgggttcgccagcaagttccggcgcgcgtggttgctctgacggggtcctccggcaaaacctccgttaaagagatgacggcggcgattttaagccagtgcggcaacacgctttatacggcaggcaatctcaacaacgacatcggtgtaccgatgacgctgttgcgcttaacgccggaatacgattacgcagttattgaacttggcgcgaaccatcagggcgaaatagcctggactgtgagtctgactcgcccggaagctgcgctggtcaacaacctggcagcggcgcatctggaaggttttggctcgcttgcgggtgtcgcgaaagcgaaaggtgaaatctttagcggcctgccggaaaacggtatcgccattatgaacgccgacaacaacgactggctgaactggcagagcgtaattggctcacgcaaagtgtggcgtttctcacccaatgccgccaacagcgatttcaccgccaccaatatccatgtgacctcgcacggtacggaatttaccctacaaaccccaaccggtagcgtcgatgttctgctgccgttgccggggcgtcacaatattgcgaatgcgctggcagccgctgcgctctccatgtccgtgggcgcaacgcttgatgctatcaaagcggggctggcaaatctgaaagctgttccaggccgtctgttccccatccaactggcagaaaaccagttgctgctcgacgactcctacaacgccaatgtcggttcaatgactgcagcagtccaggtactggctgaaatgccgggctaccgcgtgctggtggtgggcgatatggcggaactgggcgctgaaagcgaagcctgccatgtacaggtgggcgaggcggcaaaagctgctggtattgaccgcgtgttaagcgtgggtaaacaaagccatgctatcagcaccgccagcggcgttggcgaacattttgctgataaaactgcgttaattacgcgtcttaaattactgattgctgagcaacaggtaattacgattttagttaagggttcacgtagtgccgccatggaagaggtagtacgcgctttacaggagaatgggacatgttagtttggctggccgaacatttggtcaaatattattccggctttaacgtcttttcctatctgacgtttcgcgccatcgtcagcctgctgaccgcgctgttcatctcattgtggatgggcccgcgtatgattgctcatttgcaaaaactttcctttggtcaggtggtgcgtaacgacggtcctgaatcacacttcagcaagcgcggtacgccgaccatgggcgggattatgatcctgacggcgattgtgatctccgtactgctgtgggcttacccgtccaatccgtacgtctggtgcgtgttggtggtgctggtaggttacggtgttattggctttgttgatgattatcgcaaagtggtgcgtaaagacaccaaagggttgatcgctcgttggaagtatttctggatgtcggtcattgcgctgggtgtcgccttcgccctgtaccttgccggcaaagacacgcccgcaacgcagctggtggtcccattctttaaagatgtgatgccgcagctggggctgttctacattctgctggcttacttcgtcattgtgggtactggcaacgcggtaaacctgaccgatggtctcgacggcctggcaattatgccgaccgtatttgtcgccggtggttttgcgctggtggcgtgggcgaccggcaatatgaactttgccagctacttgcatataccgtatctgcgacacgccggggaactggttattgtctgtaccgcgatagtcggggcaggactgggcttcctgtggtttaacacctatccggcgcaggtctttatgggcgatgtaggttcgctggcgttaggtggtgcgttaggcattatcgccgtactgctacgtcaggaattcctgctggtgattatggggggcgtgttcgtggtagaaacgctttctgtcatcctgcaggtcggctcctttaaactgcgcggacaacgtattttccgcatggcaccgattcatcaccactatgaactgaaaggctggccggaaccgcgcgtcattgtgcgtttctggattatttcgctgatgctggttctgattggtctggcaacgctgaaggtacgttaatcatggctgattatcagggtaaaaatgtcgtcattatcggcctgggcctcaccgggctttcctgcgtggactttttcctcgctcgcggtgtgacgccgcgcgttatggatacgcgtatgacaccgcctggcctggataaattacccgaagccgtagaacgccacacgggcagtctgaatgatgaatggctgatggcggcagatctgattgtcgccagtcccggtattgcactggcgcatccatccttaagcgctgccgctgatgccggaatcgaaatcgttggcgatatcgagctgttctgtcgcgaagcacaagcaccgattgtggcgattaccggttctaacggcaaaagcacggtcaccacgctagtgggtgaaatggcgaaagcggcgggggttaacgttggtgtgggtggcaatattggcctgcctgcgttgatgctactggatgatgagtgtgaactgtacgtgctggaactgtcgagcttccagctggaaaccacctccagcttacaggcggtagcagcgaccattctgaacgtgactgaagatcatatggatcgctatccgtttggtttacaacagtatcgtgcagcaaaactgcgcatttacgaaaacgcgaaagtttgcgtggttaatgctgatgatgccttaacaatgccgattcgcggtgcggatgaacgctgcgtcagctttggcgtcaacatgggtgactatcacctgaatcatcagcagggcgaaacctggctgcgggttaaaggcgagaaagtgctgaatgtgaaagagatgaaactttccgggcagcataactacaccaatgcgctggcggcgctggcgctggcagatgctgcagggttaccgcgtgccagcagcctgaaagcgttaaccacattcactggtctgccgcatcgctttgaagttgtgctggagcataacggcgtacgttggattaacgattcgaaagcgaccaacgtcggcagtacggaagcggcgctgaatggcctgcacgtagacggcacactgcatttgttgctgggtggcgatggtaaatcggcggactttagcccactggcgcgttacctgaatggcgataacgtacgtctgtattgtttcggtcgtgacggcgcgcagctggcggcgctacgcccggaagtggcagaacaaaccgaaactatggaacaggcgatgcgcttgctggctccgcgtgttcagccgggcgatatggttctgctctccccagcctgtgccagccttgatcagttcaagaactttgaacaacgaggcaatgagtttgcccgtctggcgaaggagttaggttgatgcgtttatctctccctcgcctgaaaatgccgcgcctgccaggattcagtatcctggtctggatctccacggcgctaaagggctgggtgatgggctcgcgggaaaaagataccgacagcctgatcatgtacgatcgcaccttactgtggctgaccttcggcctcgcggcgattggctttatcatggtgacctcggcgtcaatgcccatagggcaacgcttaaccaacgatccgttcttcttcgcgaagcgtgatggtgtctatctgattttggcgtttattctggcgatcattacgctgcgtctgccgatggagttctggcaacgctacagtgccacgatgctgctcggatctatcatcctgctgatgatcgtcctggtagtgggtagctcggttaaaggggcatcgcgttggatcgatctcggtttgctgcgtatccagcctgcggagctgacaaaactgtcgctgttttgctatatcgccaactatctggtgcgtaaaggcgacgaagtacgtaataacctgcgcggcttcctgaaaccgatgggcgtgattctggtgttggcagtgttactgctggcacagccagaccttggtacggtggtggtgttgtttgtgactacgctggcgatgttgttcctggcgggagcgaaattgtggcagttcattgccattatcggtatgggcatttcagcggttgtgttgctgatactcgccgaaccgtaccgtatccgccgtgttaccgcattctggaacccgtgggaagatccctttggcagcggctatcagttaacgcaatcgctgatggcgtttggtcgcggcgaactttgggggcaaggtttaggtaactcggtacaaaaactggagtatctgccggaagcgcacactgactttattttcgccattatcggcgaagaactggggtatgtcggtgtggtgctggcacttttaatggtattcttcgtcgcttttcgcgcgatgtcgattggccgtaaagcattagaaattgaccaccgtttttccggttttctcgcctgttctattggcatctggtttagcttccaggcgctggttaacgtaggcgcggcggcggggatgttaccgaccaaaggtctgacattgccgctgatcagttacggtggttcgagcttactgattatgtcgacagccatcatgatgctgttgcgtattgattatgaaacgcgtctggagaaagcgcaggcgtttgtacgaggttcacgatgagtggtcaaggaaagcgattaatggtgatggcaggcggaaccggtggacatgtattcccgggactggcggttgcgcaccatctaatggctcagggttggcaagttcgctggctggggactgccgaccgtatggaagcggacttagtgccaaaacatggcatcgaaattgatttcattcgtatctctggtctgcgtggaaaaggtataaaagcactgatagctgccccgctgcgtatcttcaacgcctggcgtcaggcgcgggcgattatgaaagcgtacaaacctgacgtggtgctcggtatgggaggctacgtgtcaggtccaggtggtctggccgcgtggtcgttaggcattccggttgtacttcatgaacaaaacggtattgcgggcttaaccaataaatggctggcgaagattgccaccaaagtgatgcaggcgtttccaggtgctttccctaatgcggaagtagtgggtaacccggtgcgtaccgatgtgttggcgctgccgttgccgcagcaacgtttggctggacgtgaaggtccggttcgtgtgctggtagtgggtggttctcagggcgcacgcattcttaaccagacaatgccgcaggttgctgcgaaactgggtgattcagtcactatctggcatcagagcggcaaaggttcgcaacaatccgttgaacaggcgtatgccgaagcggggcaaccgcagcataaagtgacggaatttattgatgatatggcggcggcgtatgcgtgggcggatgtcgtcgtttgccgctccggtgcgttaacggtgagtgaaatcgccgcggcaggactaccggcgttgtttgtgccgtttcaacataaagaccgccagcaatactggaatgcgctaccgctggaaaaagcgggcgcagccaaaattatcgagcagccacagcttagcgtggatgctgtcgccaacaccctggccgggtggtcgcgagaaaccttattaaccatggcagaacgcgcccgcgctgcatccattccggatgccaccgagcgagtggcaaatgaagtgagccgggttgcccgggcgtaattgtagcgatgccttttgcatcgtatgaatttaagaagttaatggcgtaaagaatgaatacacaacaattggcaaaactgcgttccatcgtgcccgaaatgcgtcgcgttcggcacatacattttgtcggcattggtggtgccggtatgggcggtattgccgaagttctggccaatgaaggttatcagatcagtggttccgatttagcgccaaatccggtcacgcagcagttaatgaatctgggtgcgacgatttatttcaaccatcgcccggaaaacgtacgtgatgccagcgtggtcgttgtttccagcgcgatttctgccgataacccggaaattgtcgccgctcatgaagcgcgtattccggtgatccgtcgtgccgaaatgctggctgagttaatgcgttttcgtcatggcatcgccattgccggaacgcacggcaaaacgacaaccaccgcgatggtttccagcatctacgcagaagcggggctcgacccaaccttcgttaacggcgggctggtaaaagcggcgggggttcatgcgcgtttggggcatggtcggtacctgattgccgaagcagatgagagtgatgcatcgttcctgcatctgcaaccgatggtggcgattgtcaccaatatcgaagccgaccacatggatacctaccagggcgactttgagaatttaaaacagacttttattaattttctgcacaacctgccgttttacggtcgtgcggtgatgtgtgttgatgatccggtgatccgcgaattgttaccgcgagtggggcgtcagaccacgacttacggcttcagcgaagatgccgacgtgcgtgtagaagattatcagcagattggcccgcaggggcactttacgctgctgcgccaggacaaagagccgatgcgcgtcaccctgaatgcgccaggtcgtcataacgcgctgaacgccgcagctgcggttgcggttgctacggaagagggcattgacgacgaggctattttgcgggcgcttgaaagcttccaggggactggtcgccgttttgatttcctcggtgaattcccgctggagccagtgaatggtaaaagcggtacggcaatgctggtcgatgactacggccaccacccgacggaagtggacgccaccattaaagcggcgcgcgcaggctggccggataaaaacctggtaatgctgtttcagccgcaccgttttacccgtacgcgcgacctgtatgatgatttcgccaatgtgctgacgcaggttgataccctgttgatgctggaagtgtatccggctggcgaagcgccaattccgggagcggacagccgttcgctgtgtcgcacaattcgtggacgtgggaaaattgatcccattctggtgccggatccggcgcgggtagccgagatgctggcaccggtattaaccggtaacgacctgattctcgttcagggggctggtaatattggaaaaattgcccgttctttagctgaaatcaaactgaagccgcaaactccggaggaagaacaacatgactgataaaatcgcggtcctgttgggtgggacctccgctgagcgggaagtttctctgaattctggcgcagcggtgttagccggactgcgtgaaggcggtattgacgcgtatcctgtcgacccgaaagaagtcgacgtgacgcaactgaagtcgatgggctttcagaaagtgtttatcgcgctacacggtcgcggcggtgaagatggtacgctgcaggggatgctcgagctgatgggcttgccttataccggaagcggagtgatggcatctgcgctttcaatggataaactacgcagcaaacttctatggcaaggtgccggtttaccggtcgcgccgtgggtagcgttaacccgcgcagagtttgaaaaaggcctgagcgataagcagttagcagaaatttctgctctgggtttgccggttatcgttaagccgagccgcgaaggttccagtgtgggaatgtcaaaagtagtagcagaaaatgctctacaagatgcattaagattggcatttcagcacgatgaagaagtattgattgaaaaatggctaagtgggccggagttcacggttgcgatactcggtgaagaaattttaccgtcaatacgtattcaaccgtccggaaccttctatgattatgaggcgaagtatctctctgatgagacacagtatttctgccccgcaggtctggaagcgtcacaagaggccaatttgcaggcattagtgctgaaagcatggacgacgttaggttgcaaaggatggggacgtattgacgttatgctggacagcgatggacagttttatctgctggaagccaatacctcaccgggtatgaccagccacagcctggtgccgatggcggcacgtcaggcaggtatgagcttctcgcagttggtagtacgaattctggaactggcggactaatatgtcgcaggctgctctgaacacgcgaaacagcgaagaagaggtttcttctcgccgcaataatggaacgcgtctggcggggatccttttcctgctgaccgttttaacgacagtgttggtgagcggctgggtcgtgttgggctggatggaagatgcgcaacgcctgccgctctcaaagctggtgttgaccggtgaacgccattacacacgtaatgacgatatccggcagtcgatcctggcattgggtgagccgggtacctttatgacccaggatgtcaacatcatccagacgcaaatagaacaacgcctgccgtggattaagcaggtgagcgtcagaaagcagtggcctgatgaattgaagattcatctggttgaatatgtgccgattgcgcggtggaatgatcaacatatggtagacgcggaaggaaataccttcagcgtgccgccagaacgcaccagcaagcaggtgcttccaatgctgtatggcccggaaggcagcgccaatgaagtgttgcagggctatcgcgaaatggggcagatgctggcaaaggacagatttactctgaaggaagcggcgatgaccgcgcggcgttcctggcagttgacgctgaataacgatattaagctcaatcttggccggggcgatacgatgaaacgtttggctcgctttgtagaactttatccggttttacagcagcaggcgcaaaccgatggcaaacggattagctacgttgatttgcgttatgactctggagcggcagtaggctgggcgcccttgccgccagaggaatctactcagcaacaaaatcaggcacaggcagaacaacaatgatcaaggcgacggacagaaaactggtagtaggactggagattggtaccgcgaaggttgccgctttagtaggggaagttctgcccgacggtatggtcaatatcattggcgtgggcagctgcccgtcgcgtggtatggataaaggcggggtgaacgacctcgaatccgtggtcaagtgcgtacaacgcgccattgaccaggcagaattgatggcagattgtcagatctcttcggtatatctggcgctttctggtaagcacatcagctgccagaatgaaattggtatggtgcctatttctgaagaagaagtgacgcaagaagatgtggaaaacgtcgtccataccgcgaaatcggtgcgtgtgcgcgatgagcatcgtgtgctgcatgtgatcccgcaagagtatgcgattgactatcaggaagggatcaagaatccggtaggactttcgggcgtgcggatgcaggcaaaagtgcacctgatcacatgtcacaacgatatggcgaaaaacatcgtcaaagcggttgaacgttgtgggctgaaagttgaccaactgatatttgccggactggcatcaagttattcggtattgacggaagatgaacgtgaactgggtgtctgcgtcgtcgatatcggtggtggtacaatggatatcgccgtttataccggtggggcattgcgccacactaaggtaattccttatgctggcaatgtcgtgaccagtgatatcgcttacgcctttggcacgccgccaagcgacgccgaagcgattaaagttcgccacggttgtgcgctgggttccatcgttggaaaagatgagagcgtggaagtgccgagcgtaggtggtcgtccgccacggagtctgcaacgtcagacactggcagaggtgatcgagccgcgctataccgagctgctcaacctggtcaacgaagagatattgcagttgcaggaaaagcttcgccaacaaggggttaaacatcacctggcggcaggcattgtattaaccggtggcgcagcgcagatcgaaggtcttgcagcctgtgctcagcgcgtgtttcatacgcaagtgcgtatcggcgcgccgctgaacattaccggtttaacggattatgctcaggagccgtattattcgacggcggtgggattgcttcactatgggaaagagtcacatcttaacggtgaagctgaagtagaaaaacgtgttacagcatcagttggctcgtggatcaagcgactcaatagttggctgcgaaaagagttttaatttttatgaggccgacgatgattacggcctcaggcgacaggcacaaatcggagagaaactatgtttgaaccaatggaacttaccaatgacgcggtgattaaagtcatcggcgtcggcggcggcggcggtaatgctgttgaacacatggtgcgcgagcgcattgaaggtgttgaattcttcgcggtaaataccgatgcacaagcgctgcgtaaaacagcggttggacagacgattcaaatcggtagcggtatcaccaaaggactgggcgctggcgctaatccagaagttggccgcaatgcggctgatgaggatcgcgatgcattgcgtgcggcgctggaaggtgcagacatggtctttattgctgcgggtatgggtggtggtaccggtacaggtgcagcaccagtcgtcgctgaagtggcaaaagatttgggtatcctgaccgttgctgtcgtcactaagcctttcaactttgaaggcaagaagcgtatggcattcgcggagcaggggatcactgaactgtccaagcatgtggactctctgatcactatcccgaacgacaaactgctgaaagttctgggccgcggtatctccctgctggatgcgtttggcgcagcgaacgatgtactgaaaggcgctgtgcaaggtatcgctgaactgattactcgtccgggtttgatgaacgtggactttgcagacgtacgcaccgtaatgtctgagatgggctacgcaatgatgggttctggcgtggcgagcggtgaagaccgtgcggaagaagctgctgaaatggctatctcttctccgctgctggaagatatcgacctgtctggcgcgcgcggcgtgctggttaacatcacggcgggcttcgacctgcgtctggatgagttcgaaacggtaggtaacaccatccgtgcatttgcttccgacaacgcgactgtggttatcggtacttctcttgacccggatatgaatgacgagctgcgcgtaaccgttgttgcgacaggtatcggcatggacaaacgtcctgaaatcactctggtgaccaataagcaggttcagcagccagtgatggatcgctaccagcagcatgggatggctccgctgacccaggagcagaagccggttgctaaagtcgtgaatgacaatgcgccgcaaactgcgaaagagccggattatctggatatcccagcattcctgcgtaagcaagctgattaagaattgactggaatttgggtttcgaggctctttgtgctaaactggcccgccgaatgtatagtacacttcggttggataggtaatttggcgagataatacgatgatcaaacaaaggacacttaaacgtatcgttcaggcgacgggtgtcggtttacataccggcaagaaagtcaccctgacgttacgccctgcgccggccaacaccggggtcatctatcgtcgcaccgacttgaatccaccggtagatttcccggccgatgccaaatctgtgcgtgataccatgctctgtacgtgtctggtcaacgagcatgatgtacggatttcaaccgtagagcacctcaatgctgctctcgcgggcttgggcatcgataacattgttatcgaagttaacgcgccggaaatcccgatcatggacggcagcgccgctccgtttgtatacctgctgcttgacgccggtatcgacgagttgaactgcgccaaaaaatttgttcgcatcaaagagactgttcgtgtcgaagatggcgataagtgggctgaatttaagccgtacaatggtttttcgctggatttcaccatcgattttaaccatccggctattgattccagcaaccagcgctatgcgatgaacttctccgctgatgcgtttatgcgccagatcagccgtgcgcgtacgttcggtttcatgcgtgatatcgaatatctgcagtcccgtggtttgtgcctgggcggcagcttcgattgtgccatcgttgttgacgattatcgcgtactgaacgaagacggcctgcgttttgaagacgaatttgtgcgtcacaaaatgctcgatgcgatcggtgacttgttcatgtgtggtcacaatattattggtgcatttaccgcttataaatccggtcatgcactgaataacaaactgctgcaggctgtcctggcgaaacaggaagcctgggaatatgtgaccttccaggacgacgcagaactgccgttggccttcaaagcgccttcagctgtactggcataacgacatttatactgtcgtataaaattcgactggcaaatctggcactctctccggccaggtgaaccagtcgtttttttttgaattttataagagctataaaaaacggtgcgaacgctgttttcttaagcacttttccgcacaacttatcttcattcgtgctgtggactgcaggctttaatgataagatttgtgcgctaaatacgtttgaatatgatcgggatggcaataacgtgagtggaatactgacgcgctggcgacagtttggtaaacgctacttctggccgcatctcttattagggatggttgcggcgagtttaggtttgcctgcgctcagcaacgccgccgaaccaaacgcgcccgcaaaagcgacaacccgcaaccacgagccttcagccaaagttaactttggtcaattggccttgctggaagcgaacacacgccgcccgaattcgaactattccgttgattactggcatcaacatgccattcgcacggtaatccgtcatctttctttcgcaatggcaccgcaaacactgcccgttgctgaagaatctttgcctcttcaggcgcaacatcttgcattactggatacgctcagcgcgctgctgacccaggaaggcacgccgtctgaaaagggttatcgcattgattatgcgcattttaccccacaagcaaaattcagcacgcccgtctggataagccaggcgcaaggcatccgtgctggccctcaacgcctcacctaacaacaataaacctttacttcattttattaactccgcaacgcggggcgtttgagattttattatgctaatcaaattgttaactaaagttttcggtagtcgtaacgatcgcaccctgcgccggatgcgcaaagtggtcaacatcatcaatgccatggaaccggagatggaaaaactctccgacgaagaactgaaagggaaaaccgcagagtttcgtgcacgtctggaaaaaggcgaagtgctggaaaatctgatcccggaagctttcgccgtggtacgtgaggcaagtaagcgcgtctttggtatgcgtcacttcgacgttcagttactcggcggtatggttcttaacgaacgctgcatcgccgaaatgcgtaccggtgaaggaaaaaccctgaccgcaacgctgcctgcttacctgaacgcactaaccggtaaaggcgtgcacgtagttaccgtcaacgactacctggcgcaacgtgacgccgaaaacaaccgtccgctgtttgaattccttggcctgactgtcggtatcaacctgccgggcatgccagcaccggcaaagcgcgaagcttacgcagctgacatcacttacggtacgaacaacgaatacggctttgactacctgcgcgacaacatggcgttcagccctgaagaacgtgtacagcgtaaactgcactatgcgctggtggacgaagtggactccatcctgatcgatgaagcgcgtacaccgctgatcatttccggcccggcagaagacagctcggaaatgtataaacgcgtgaataaaattattccgcacctgatccgtcaggaaaaagaagactccgaaaccttccagggcgaaggccacttctcggtggacgaaaaatctcgccaggtgaacctgaccgaacgtggtctggtgctgattgaagaactgctggtgaaagagggcatcatggatgaaggggagtctctgtactctccggccaacatcatgctgatgcaccacgtaacggcggcgctgcgcgctcatgcgctgtttacccgtgacgtcgactacatcgttaaagatggtgaagttatcatcgttgacgaacacaccggtcgtaccatgcagggccgtcgctggtccgatggtctgcaccaggctgtggaagcgaaagaaggtgtgcagatccagaacgaaaaccaaacgctggcttcgatcaccttccagaactacttccgtctgtatgaaaaactggcggggatgaccggtactgctgataccgaagctttcgaatttagctcaatctacaagctggataccgtcgttgttccgaccaaccgtccaatgattcgtaaagatctgccggacctggtctacatgactgaagcggaaaaaattcaggcgatcattgaagatatcaaagaacgtactgcgaaaggccagccggtgctggtgggtactatctccatcgaaaaatcggagctggtgtcaaacgaactgaccaaagccggtattaagcacaacgtcctgaacgccaaattccacgccaacgaagcggcgattgttgctcaggcaggttatccggctgcggtgactatcgcgaccaatatggcgggtcgtggtacagatattgtgctcggtggtagctggcaggcagaagttgccgcgctggaaaatccgaccgcagagcaaattgaaaaaattaaagccgactggcaggtacgtcacgatgcggtactggaagcaggtggcctgcatatcatcggtaccgagcgtcacgaatcccgtcgtatcgataaccagttgcgcggtcgttctggtcgtcagggggatgctggttcttcccgtttctacctgtcgatggaagatgcgctgatgcgtatttttgcttccgaccgagtatccggcatgatgcgtaaactgggtatgaagccaggcgaagccattgaacacccgtgggtgactaaagcgattgccaacgcccagcgtaaagttgaaagccgtaacttcgacattcgtaagcaactgctggaatatgatgacgtggctaacgatcagcgtcgcgccatttactcccagcgtaacgaactgttggatgtcagcgatgtgagcgaaaccattaacagcattcgtgaagatgtgttcaaagcgaccattgatgcctacattccaccacagtcgctggaagaaatgtgggatattccggggctgcaggaacgtctgaagaacgatttcgacctcgatttgccaattgccgagtggctggataaagaaccagaactgcatgaagagacgctgcgtgagcgcattctggcgcagtccatcgaagtgtatcagcgtaaagaagaagtggttggtgctgagatgatgcgtcacttcgagaaaggcgtcatgctgcaaacgcttgactccctgtggaaagagcacctggcagcgatggactatctgcgtcagggtatccacctgcgtggctacgcacagaaagatccgaagcaggaatacaaacgtgaatcgttctccatgtttgcagcgatgctggagtcgttgaaatatgaagttatcagtacgctgagcaaagttcaggtacgtatgcctgaagaggttgaggagctggaacaacagcgtcgtatggaagccgagcgtttagcgcaaatgcagcagcttagccatcaggatgacgactctgcagccgcagctgcactggcggcgcaaaccggagagcgcaaagtaggacgtaacgatccttgcccgtgcggttctggtaaaaaatacaagcagtgccatggccgcctgcaataaaagctaactgttgaagtaaaaggcgcaggattctgcgccttttttataggtttaagacaatgaaaaagctgcaaattgcggtaggtattattcgcaacgagaacaatgaaatctttataacgcgtcgcgcagcagatgcgcacatggcgaataaactggagtttcccggcggtaaaattgaaatgggtgaaacgccggaacaggcggtggtgcgtgaacttcaggaagaagtcgggattaccccccaacatttttcgctatttgaaaaactggaatatgaattcccggacaggcatataacactgtggttttggctggtcgaacgctgggaaggggagccgtggggtaaagaagggcaacccggtgagtggatgtcgctggtcggtcttaatgccgatgattttccgccagccaatgaaccggtaattgcgaagcttaaacgtctgtaggtcagataaggcgttttcgccgcatccgacattcgcacacgatgcctgatgcgacgctggcgcgtcttatcaggcctaaagggatttctaactcattgataaatttgtttttgtaggtcggataaggcgttcacgccgcatccgacatttgcacaagatgcctgatgcgacgctgtccgcgtcttatcaggcctacgtgcggcatcagacaaatgtcactgctttggttcttcgctccagtcatcgctttcggaaagatcgccactgctggggattcgtttttcttcagcagcccattctccgaggtcgatcagctgacaacgtttggagcaaaatggccgaaacgggctgatttcaccccacaccaccgttttcccgcaggttgggcaattcaccgtaatagtttctgacatttttactccttagcaacaggccagttcgaaatccagacgttccggtacctgtccgttttcagtgtccagcggcataaaacgaatggcaaaacggctcttatgtccggaaatttgcggataaagctgtgaatcgagcgacagattcaggcgcagcaagtcggcatcgccaccgttatcctgataaaaaccattcaggctggtttgtttacggaagggggccgactggcgaattaaatccagcaccatggtaagtgcctgggtgagcgggttcaggctggcaatccaggtttctacctggctgtcgcgctgcgcctggggtagatgcagccaaatgtgcaatgtaggtaaatcaaagctgcaacagccgcctgggatgctcagtcgctgacgcaccagagcaatcaaacgatcttcacgcagaaattgcccgatacgcggcgcggaaattaatacgctccccgccgcttttaactgctgaattaatgcttcaatacggctctggtccacgccaggcacgccaatccaggtctggagtttacgttgctgccggtcaagttctttcaacagctcagtgcggacttcgccgcgctcgaaaacatccagtaattcactgacattacggaagaaatgcagcgcgccagcgtggtcaacgatgggtaaattaacggtgagttgctgaatcaaaaactcaatgcgcagccatgtacgcattttttcatttagtggatgttcaaaaaggacctgggtctgcattacggtttttcctgtgagacaaactgcgacgcaagctgcaaatagtgtgcgtgcaggcgggcaacatccgatgcgatagcatccggtgcgccgttattatcaatgacgtcatctgccacggcaaggcgggcttcgcgcgttgcctgagcagcaaggatttgttcgacatgctcgcgagttacatcatcgcgctgcatggtgcgcttaagttgcgtttctgggctgacatccaccacaagcactcgattcgcttttttatacagtgagttttctaccagcaatggcacaacccacagtacatagggggaagtagcttgctggatctggtgttgcgtctcttgctgaatcagcggatgcagcagggcgttaagccagtttttctcttccgggttggcgaagatccgctcgcgcaaggcccggcgctgcaatgttccatcagcagcaatcatgttagcgccaaagtgatcagcaatggcatgtagcgcaggtgcacctggttcaaccacctgacgcgcaataatatcggcatcaatgacgttaattccgagatcagcaaacgcattggcaacggtactcttgccactgccaatgcctcccgttaaggcaactatatacctcataatttatattcccgggaattcatcatgattatcaaaacgttaaaaatgagtgcacgaaagcgaaattgatgaaacgttcgctcactatttaccaggtaaatttatgggattgtagcgtaaaaaaagacaatttcgcagtcttgcgccgcattgattagtgcgtatgatagcgtcactggagttgcgctcttacccttatagccattaaccccaggaatccgcacatgcgtattgaagaagatctgaagttaggttttaaagacgttctcatccgccctaaacgctccactcttaaaagccgttccgatgttgaactggaacgtcaattcaccttcaaacattcaggtcagagctggtccggcgtgccgattatcgccgcaaatatggacaccgtaggcacattttctatggcctctgcgctggcttcttttgatattttgactgctgtgcataaacactattctgtcgaagagtggcaagcgtttatcaacaattcttccgctgatgtgctgaaacatgtgatggtttctaccggtacgtctgatgcggatttcgaaaaaactaaacagattctcgacctgaacccggcattaaacttcgtttgtattgacgtggcgaatggttattccgaacacttcgtgcagttcgttgcgaaagcgcgtgaagcgtggccgaccaaaaccatttgtgctggtaacgtagtgactggtgaaatgtgtgaggagcttatcctctcaggtgccgatatcgttaaagttggcattggcccaggttctgtttgtacaactcgcgtcaaaacaggcgtcggttatccgcaactttctgcggtaatcgaatgtgccgatgctgcgcacggtctgggcggaatgatcgtcagcgatggtggctgcaccacgccgggcgatgtggcgaaagcctttggcggcggtgccgatttcgtcatgcttggcggcatgctggcgggccacgaagagagcggcggtcgcatcgttgaggagaacggcgagaaatttatgctgttctacggcatgagctccgagtctgcgatgaaacgtcacgttggcggcgttgcggaatatcgcgcagcagaaggtaaaaccgttaagctgccgctgcgaggcccggttgaaaataccgcgcgagatattttgggcggcctgcgttcagcttgtacatacgttggggcttcacgcctgaaagagctgaccaagcgcaccacgtttattcgtgtgcaggaacaagaaaaccgcatcttcaacaacctgtaatctcccaacgctggcgtggagcaacacgccagcgttatcccatcccactcatcgcatcgcctaaatggaaaattggcagatacattgccaccaccagcgtaccaataattcctcccgttatgatcagcaacgccggttccagtaaggctgcgaggttatccgccagcgccattgtgttttcccgatgatgatgggcgaggttgtctaacatgagatccagagagccggatgcctctcctgttctcactaattgcaaacagagcgggctaaactcaccggtattttttagcgccagccagatgggttgaccgttactgatatcgtgctggatttgtgtcagaagttgcacccagtacgggcagcgcattgtttctctgacgctctctacgccctgtaaaaaagtaatgcctgcactttgtgtcagcgccagaatcgtaaagatctgcgtgagtttttgtccccgcatcagtgaacccataatcgggatgcgtaacagcaatttctgccgcactataagccaggtcggtcggcgcatcagcaacttattggctatcgccagcagaaagccgaacaacaccagcagccagctccattcgccactaaagtctgccagcgtcatgatcccctgcgttagtgccggtagtggggtgttgaaggtcttatagatagcggcaaactccggcagaacaaaatgcagcattgccacaaccaccatgattgccatcgctaaaatgatgatgggataacgtaacgctgatttcactttgtcggtcaactgacgctgggctttttgctgacgcgccagttcaaagcagcattcatccagcttaccggtcagttcacccgtgcggatcatcgcctgatagagcggcggaaatacctctgaccagggtaataaggcattggaaaaagcaatgccctgttcgagatcgtgcgccagcgattgcagcaacgcttgccattgcttactgggatgctgttccgccagcagagccagcccttcagaaagcgttaaccctgctttgagtagcgtcgccagttgatgaatgacttccgcgcttttatctcctcgccactgcgcagaattgatggcgattcgcttcaggcttagtggggtaaccatctgttgctgtagtgccataagcagtaaagtacggctctctgcccatagcatcccatcttgcgcattgccgtcgccggttatgccatgccagcgccagagttgcttactcgccatgcggcatccccagtacgcggattaactcttcaaaggtggttaagccttgctctacggccaggcagccgttttcaaaaagcgtacgcatacccgcctgtcgtgcgtgcgtttccagcgattcaacgtcggtattagcggaaataagctgacgaatgaccggcgttatgggcagaacttcaaataaggccgtacgaccataaaaaccgtggtagcaatgtacacaaccgggtgcctgccagtggggcagcggcgatggccatacattgtctggaatgtggatgggctccccttgctgccggcgacaatgtgggcaaagtttgcgtaccagacgctgggctattaccagcgtaagcgccgatgatagcatccagcgggcgacccccatttgctgtaaacgtaccagcgtttcgcaggtggaattagtgtgtagggtagacaacaccaggtgaccagtttgcgccgctttaatagcgatctctgctgtttcgccatcgcggatctctccgatcatgatgacgtcaggatcctggcgcaataacgcacgcaaaacgccctgaaaggtgagtccggcacgcggatggatttgcgtctggtttagtccggctatggggatctcaactggatcttcgacgctacaaatattaatgtcagcggtattcagcttttgcagggcactataaagcgtgaccgttttgccgctgccggtagggccagttaccagcaccagtccctgtggttgttgcaaggcatgagcaaagtccgccagttgtaacggctgcattccaagcgtgttgacatccagtgcctgacccacctgctgtaacaaccttaataccaccttttcaccaccccgacatggtaaggtcgcaatacgaaatgagacggcgtttcctgccagttcgacagtgaattgcccgtcctgcggcaggcgatgttccgcaatatccaggtttcccagcacttttaatctggcggttaatgcgactccggcatccggtgaaacatccggtaaaggatgcaatacgccgtcgatacgcaagcggatgcggtaggcattgtccgctggttcgatatgaatatcagacgcgcgttgttccagcgcagattgtaacgttcgagttagcaactctgctttgggctgatgcttctcctgaacagctacgggcaatgtctgttgtgtgcgactggcgtgaccttccatttgttggcgcgtccagcaggtgatctcaatacgtttggtggtagcgaaatgcaatgcgtccagtagctcatgcgaaggtgcatcgactaccgcaacatgaaccacctcttcgctggcatccagcaagactccatgataacgcagacacagggcagtgagctgtggaatattcattgccgctccttagttggcgtcatcaaagcggaagacatcttcgcaggcttgctgcaatgcgctgtcactttgaatattgcagttgcgcgtccagccggtgacgccgtttgcgttatcccaacccggtgtcatgacgacgcttagcccattgagactttcttgcccggtcagcgacaccacgccctttgccacactcatggctgaaacatagcgggtggtggtaggcgagggaatgccattgctgccaccgtcgcaggtatctaatccaccatgttccagcgcgcacaactctacggcggtacggtaaggcacaaaggtttgtagcatgtcggtgagtgcggctttgcgcaggtagttttgataagcgggaataccaatggcgcttaaaatggcaatgatgccaataaccaccatcagttcgataagtgtaaaaccgcgttgcttgtccatctgtttcgctccttgatttggttggcgctactttggcaaacgccatcagcacaggcgaggggcaaaaaacgaaacgggaaagcagattccgaggttttttatttcgttgcagcgaaagacaagaaatttgcgaggcgttacgaagaaagttggggaaggggagattatccgcccgcgatggagcggataaatctgtcaactattagcgaaaacgcattgaaaggtcgagtgcttgtacgtgtttagttagcgcaccgacggagataaagtccacgcccgtttcggcaaattcacgcagtgttttgtcagtgacgttgccagacacttccagtagcgccttgccgttggtgcgtttgacggcttcgcgcatctgttctgtttcgaagttatccagcatgatgatatcggctcctgctttcagggcttcatcaagttcttccagattctctacttcgacttctactggcgcatccgggtgcagccaggacgctttttcgaccgcctggcgcactgagccggaggcaataatatggttttctttgatcaggaaggcatcagaaagccccagacggtgattcgctccgccgccgcaaagtaccgcgtatttcagagctgaacgcaggccgggtaaggttttgcgcgtatccaacaactgcgtgttggtgccttccagcaattcgacatagtggcgtaccttactggcaactcctgaaagggtttgcacaaaattaagcgcagtgcgttcgcccgttaacagcacgcgggatgggccttcaagttcgaacaaggattgattggcattgatgacatcgccgtcatccacatgccagattatggtgacatcgtcgcctgccagttgaataaacacctcttcaacccagcgtttgccgcaaaagacgccattctcgcgggtgatcaccgtggcatgagagcgagaattttccggtaaaagttttgccgtaatatcattgttggcatcgactgttccgcctaaatcttcccgcagcgcctgggccaccgcgccggggatatcgagattaatgcgttccagcagctcgtcacgtcgggtgtcagggttatagcggcgaggcggcatgttaaaactccagatagctaacgaatcataaggtagaaacatgctactctgaaccgggtattagcaccacatataaggagatcctgcatgttgttagaacaggggtggctggttggcgcgcgccgcgttccctcaccacattacgattgccgcccggatgacgaaacacccaccctgctggtggtgcacaatattagcctgccgccaggcgagtttggcggtccgtggatcgacgcattattcactggaactattgatccgcaggcacatcctttctttgctgagatcgcccatttgcgcgtctccgctcactgtttgattcgccgtgatggtgaaatagtccagtatgttcctttcgataaacgtgcatggcatgcgggagtctctcagtatcaggggcgcgaacgctgcaatgatttttctattgggattgagcttgaaggcaccgatacgctggcgtataccgatgcgcagtatcaacagcttgcggcggttacgcgggcactgattgattgctatccggatatcgctaaaaacatgacgggccattgtgatattgcgccggatcggaaaaccgatcccggtcctgcatttgattgggcacggtttcgtgtgctggtcagcaaggagacaacatgacgctatttacaaccttactggtgttaattttcgagcgcctgtttaagttgggcgagcactggcagcttgatcatcgtcttgaagcgttctttcggcgggtgaaacatttttctctcgggcgcacgttaggcatgaccattattgcgatgggcgtgacttttttactgttacgcgcattgcagggagtattgttcaacgttcccacgctactggtgtggctgctgattggtttgctgtgtattggcgcaggtaaagttcgtcttcattatcatgcttatctgacagctgcttcacgtaatgatagccatgcccgtgccacgatggctggcgaactcaccatgattcacggcgtcccggcaggctgcgacgaacgtgagtatttgcgtgagctgcaaaatgcattgctgtggattaactttcgtttttatcttgcaccgctgttctggctgattgtggggggaacctggggacccgttacgctgatggggtatgcgtttttgcgtgcatggcaatactggctggcgcgatatcagacgccgcatcatcgtttacagtccggcattgatgccgtgcttcatgtactggattgggtgccggttcgtcttgcgggtgtggtatatgccttgatcggtcatggtgagaaagcgttaccggcctggtttgcttcgctgggtgatttccatacttcgcagtatcaggtgttaacgcgtctggcgcagttctctctggcgcgtgaaccgcatgtcgataaggtggagacgccgaaggcagcggtttcaatggcgaagaaaacctcgttcgtggtcgtggtggtgattgcactactgacgatttacggggcgttggtgtaaagattattgccctcaccctgtacgggtgagggcgtagagagattaatgcgcttttacggctttggcggttttctctttaaacagatagccgatacctaacacgatcagccataccgggatcaggtataccgaaatcgccattcctggggtcatcagcataatcaccagtaccgccgccataaacagcaggcagatccagttacccagcggataaagcagagcagggaagcgagttaccacgccttgttcctgcttggcgcgacggaatttcatatgcgccaggctaatcatcgcccagttgattaccagtgcagataccaccagcgccattaacagtccgaaagcggactctggggcaaggtagttaatcagtacgcacaacgccgttaccagtgcagacaccagaatggtatttactggtacaccacgtttatcgacagacgccagcgcttttggcgcattaccctgttgtgccagaccaaacagcatacggctgttgcaatatacgcagctgttgtacacggagagcgccgcagtcagtaccacgatgttcagcgcattcgccacaaaggtatcgcctaactcgtggaagatcagcacaaacggactggtatcggcggtaacgcgggtccacggcatcagtgagagcagaacggctaacgaaccaatatagaaaatcaggatgcggtagataacctggttagttgctttcggtatactttgctccgggttatcagcttctgctgcggtgatccccaccagttccagaccaccgaacgagaacatgataatcgccatcatcatcaccagcccggtgaagccgtgcggcaggaaaccaccctgatcccacaggttgctaacggtcgcctgcgggccgccgttgccactgaatagcagccagccgccgaagatgatcatcgctaccaccgcgataactttgataatggcaaaccagaactccatctcgccaaacactttaacgttggtcaggttgatggcgttaatcaccacaaagaatacggcggcagaaacccaggtggggatttccggataccagaactgaatgtatttacccacggcagtcagctcagccatggcaactaaaacgtacagtacccagtagttccagccagaggcgaaaccggcaaaactgccccagtatttataagcaaagtggctaaaggagcctgcgacaggttcttcgaccaccatttcacccagctgacgcatgatcagaaaggcgataaaaccagcaatggcgtaacccaggataatccctggccctgcggactgtattacggaggcgctacccaggaataacccggtccctatcgcgccacccagcgcgataagctgaatatggcggtttttaaggccgcgctttagctgctcgccgtgctgttgaccttccatcatgaaacctcgtgcggtggttgtttttttgatctacgcagtgatgcgtgtgtaagtttgcaattccgtttgttgtattaatttgtttacatcaaagaagtttgaattgttacaaaaagacttccgtcagatcaagaataatggtatgcggcagcgaatgcacccgctttatgcatggttgaagatgagttgcttaaaaagaaaccgtttgtaaagctcagcctcaacccctctcaatatgtagaatgaatttaaattcgttttaattgaattaaaaatcacaaaattggtaagtgaatcggttcaattcggatttttatagtttaataatcgttaaaaaactcctttcctacgtaaagtctacatttgtgcatagttacaactttgaaacgttatatatgtcaagttgttaaaatgtgcacagtttcatgatttcaatcaaaacctgtatggacataaggtgaatactttgttactttagcgtcacagacatgaaattggtaagaccaattgacttcggcaagtggcttaagacaggaactcatggcctacagcaaaatccgccaaccaaaactctccgatgtgattgagcagcaactggagtttttgatcctcgaaggcactctccgcccgggcgaaaaactcccaccggaacgcgaactggcaaaacagtttgacgtctcccgtccctccttgcgtgaggcgattcaacgtctcgaagcgaagggcttgttgcttcgtcgccagggtggcggcacttttgtccagagcagcctatggcaaagcttcagcgatccgctggtggagctgctctccgaccatcctgagtcacagtatgacttgctcgaaacacgacacgccctggaaggtatcgccgcttattacgccgcgctgcgtagtaccgatgaagacaaggaacgcatccgtgaactccaccacgccatagagctggcgcagcagtctggcgatctggacgcggaatcaaacgccgtactccagtatcagattgccgtcaccgaagcggcccacaatgtggttctgcttcatctgctaaggtgtatggagccgatgttggcccagaatgtccgccagaacttcgaattgctctattcgcgtcgcgagatgctgccgctggtgagtagtcaccgcacccgcatatttgaagcgattatggccggtaagccggaagaagcgcgcgaagcatcgcatcgccatctggcctttatcgaagaaattttgctcgacagaagtcgtgaagagagccgccgtgagcgttctctgcgtcgtctggagcaacgaaagaattagtgatttttctggtaaaaattatccagaagatgttgtaaatcaagcgcatataaaagcgcggcaactaaacgtagaacctgtcttattgagctttccggcgagagttcaatgggacaggttccagaaaactcaacgttattagatagataaggaataacccatgtcagaacgtttcccaaatgacgtggatccgatcgaaactcgcgactggctccaggcgatcgaatcggtcatccgtgaagaaggtgttgagcgtgctcagtatctgatcgaccaactgcttgctgaagcccgcaaaggcggtgtaaacgtagccgcaggcacaggtatcagcaactacatcaacaccatccccgttgaagaacaaccggagtatccgggtaatctggaactggaacgccgtattcgttcagctatccgctggaacgccatcatgacggtgctgcgtgcgtcgaaaaaagacctcgaactgggcggccatatggcgtccttccagtcttccgcaaccatttatgatgtgtgctttaaccacttcttccgtgcacgcaacgagcaggatggcggcgacctggtttacttccagggccacatctccccgggcgtgtacgctcgtgctttcctggaaggtcgtctgactcaggagcagctggataacttccgtcaggaagttcacggcaatggcctctcttcctatccgcacccgaaactgatgccggaattctggcagttcccgaccgtatctatgggtctgggtccgattggtgctatttaccaggctaaattcctgaaatatctggaacaccgtggcctgaaagatacctctaaacaaaccgtttacgcgttcctcggtgacggtgaaatggacgaaccggaatccaaaggtgcgatcaccatcgctacccgtgaaaaactggataacctggtcttcgttatcaactgtaacctgcagcgtcttgacggcccggtcaccggtaacggcaagatcatcaacgaactggaaggcatcttcgaaggtgctggctggaacgtgatcaaagtgatgtggggtagccgttgggatgaactgctgcgtaaggataccagcggtaaactgatccagctgatgaacgaaaccgttgacggcgactaccagaccttcaaatcgaaagatggtgcgtacgttcgtgaacacttcttcggtaaatatcctgaaaccgcagcactggttgcagactggactgacgagcagatctgggcactgaaccgtggtggtcacgatccgaagaaaatctacgctgcattcaagaaagcgcaggaaaccaaaggcaaagcgacagtaatccttgctcataccattaaaggttacggcatgggcgacgcggctgaaggtaaaaacatcgcgcaccaggttaagaaaatgaacatggacggtgtgcgtcatatccgcgaccgtttcaatgtgccggtgtctgatgcagatatcgaaaaactgccgtacatcaccttcccggaaggttctgaagagcatacctatctgcacgctcagcgtcagaaactgcacggttatctgccaagccgtcagccgaacttcaccgagaagcttgagctgccgagcctgcaagacttcggcgcgctgttggaagagcagagcaaagagatctctaccactatcgctttcgttcgtgctctgaacgtgatgctgaagaacaagtcgatcaaagatcgtctggtaccgatcatcgccgacgaagcgcgtactttcggtatggaaggtctgttccgtcagattggtatttacagcccgaacggtcagcagtacaccccgcaggaccgcgagcaggttgcttactataaagaagacgagaaaggtcagattctgcaggaagggatcaacgagctgggcgcaggttgttcctggctggcagcggcgacctcttacagcaccaacaatctgccgatgatcccgttctacatctattactcgatgttcggcttccagcgtattggcgatctgtgctgggcggctggcgaccagcaagcgcgtggcttcctgatcggcggtacttccggtcgtaccaccctgaacggcgaaggtctgcagcacgaagatggtcacagccacattcagtcgctgactatcccgaactgtatctcttacgacccggcttacgcttacgaagttgctgtcatcatgcatgacggtctggagcgtatgtacggtgaaaaacaagagaacgtttactactacatcactacgctgaacgaaaactaccacatgccggcaatgccggaaggtgctgaggaaggtatccgtaaaggtatctacaaactcgaaactattgaaggtagcaaaggtaaagttcagctgctcggctccggttctatcctgcgtcacgtccgtgaagcagctgagatcctggcgaaagattacggcgtaggttctgacgtttatagcgtgacctccttcaccgagctggcgcgtgatggtcaggattgtgaacgctggaacatgctgcacccgctggaaactccgcgcgttccgtatatcgctcaggtgatgaacgacgctccggcagtggcatctaccgactatatgaaactgttcgctgagcaggtccgtacttacgtaccggctgacgactaccgcgtactgggtactgatggcttcggtcgttccgacagccgtgagaacctgcgtcaccacttcgaagttgatgcttcttatgtcgtggttgcggcgctgggcgaactggctaaacgtggcgaaatcgataagaaagtggttgctgacgcaatcgccaaattcaacatcgatgcagataaagttaacccgcgtctggcgtaagaggtaaaagaataatggctatcgaaatcaaagtaccggacatcggggctgatgaagttgaaatcaccgagatcctggtcaaagtgggcgacaaagttgaagccgaacagtcgctgatcaccgtagaaggcgacaaagcctctatggaagttccgtctccgcaggcgggtatcgttaaagagatcaaagtctctgttggcgataaaacccagaccggcgcactgattatgattttcgattccgccgacggtgcagcagacgctgcacctgctcaggcagaagagaagaaagaagcagctccggcagcagcaccagcggctgcggcggcaaaagacgttaacgttccggatatcggcagcgacgaagttgaagtgaccgaaatcctggtgaaagttggcgataaagttgaagctgaacagtcgctgatcaccgtagaaggcgacaaggcttctatggaagttccggctccgtttgctggcaccgtgaaagagatcaaagtgaacgtgggtgacaaagtgtctaccggctcgctgattatggtcttcgaagtcgcgggtgaagcaggcgcggcagctccggccgctaaacaggaagcagctccggcagcggcccctgcaccagcggctggcgtgaaagaagttaacgttccggatatcggcggtgacgaagttgaagtgactgaagtgatggtgaaagtgggcgacaaagttgccgctgaacagtcactgatcaccgtagaaggcgacaaagcttctatggaagttccggcgccgtttgcaggcgtcgtgaaggaactgaaagtcaacgttggcgataaagtgaaaactggctcgctgattatgatcttcgaagttgaaggcgcagcgcctgcggcagctcctgcgaaacaggaagcggcagcgccggcaccggcagcaaaagctgaagccccggcagcagcaccagctgcgaaagcggaaggcaaatctgaatttgctgaaaacgacgcttatgttcacgcgactccgctgatccgccgtctggcacgcgagtttggtgttaaccttgcgaaagtgaagggcactggccgtaaaggtcgtatcctgcgcgaagacgttcaggcttacgtgaaagaagctatcaaacgtgcagaagcagctccggcagcgactggcggtggtatccctggcatgctgccgtggccgaaggtggacttcagcaagtttggtgaaatcgaagaagtggaactgggccgcatccagaaaatctctggtgcgaacctgagccgtaactgggtaatgatcccgcatgttactcacttcgacaaaaccgatatcaccgagttggaagcgttccgtaaacagcagaacgaagaagcggcgaaacgtaagctggatgtgaagatcaccccggttgtcttcatcatgaaagccgttgctgcagctcttgagcagatgcctcgcttcaatagttcgctgtcggaagacggtcagcgtctgaccctgaagaaatacatcaacatcggtgtggcggtggataccccgaacggtctggttgttccggtattcaaagacgtcaacaagaaaggcatcatcgagctgtctcgcgagctgatgactatttctaagaaagcgcgtgacggtaagctgactgcgggcgaaatgcagggcggttgcttcaccatctccagcatcggcggcctgggtactacccacttcgcgccgattgtgaacgcgccggaagtggctatcctcggcgtttccaagtccgcgatggagccggtgtggaatggtaaagagttcgtgccgcgtctgatgctgccgatttctctctccttcgaccaccgcgtgatcgacggtgctgatggtgcccgtttcattaccatcattaacaacacgctgtctgacattcgccgtctggtgatgtaagtaaaagagccggcccaacggccggcttttttctggtaatctcatgaatgtattgaggttattagcgaatagacaaatcggttgccgtttgttgtttaaaaattgttaacaattttgtaaaataccgacggatagaacgacccggtggtggttagggtattacttcacataccctatggatttctgggtgcagcaaggtagcaagcgccagaatccccaggagcttacataagtaagtgactggggtgagggcgtgaagctaacgccgctgcggcctgaaagacgacgggtatgaccgccggagataaatatatagaggtcatgatgagtactgaaatcaaaactcaggtcgtggtacttggggcaggccccgcaggttactccgctgccttccgttgcgctgatttaggtctggaaaccgtaatcgtagaacgttacaacacccttggcggtgtttgcctgaacgtcggctgtatcccttctaaagcactgctgcacgtagcaaaagttatcgaagaagccaaagcgctggctgaacacggtatcgtcttcggcgaaccgaaaaccgatatcgacaagattcgtacctggaaagagaaagtgatcaatcagctgaccggtggtctggctggtatggcgaaaggccgcaaagtcaaagtggtcaacggtctgggtaaattcaccggggctaacaccctggaagttgaaggtgagaacggcaaaaccgtgatcaacttcgacaacgcgatcattgcagcgggttctcgcccgatccaactgccgtttattccgcatgaagatccgcgtatctgggactccactgacgcgctggaactgaaagaagtaccagaacgcctgctggtaatgggtggcggtatcatcggtctggaaatgggcaccgtttaccacgcgctgggttcacagattgacgtggttgaaatgttcgaccaggttatcccggcagctgacaaagacatcgttaaagtcttcaccaagcgtatcagcaagaaattcaacctgatgctggaaaccaaagttaccgccgttgaagcgaaagaagacggcatttatgtgacgatggaaggcaaaaaagcacccgctgaaccgcagcgttacgacgccgtgctggtagcgattggtcgtgtgccgaacggtaaaaacctcgacgcaggcaaagcaggcgtggaagttgacgaccgtggtttcatccgcgttgacaaacagctgcgtaccaacgtaccgcacatctttgctatcggcgatatcgtcggtcaaccgatgctggcacacaaaggtgttcacgaaggtcacgttgccgctgaagttatcgccggtaagaaacactacttcgatccgaaagttatcccgtccatcgcctataccgaaccagaagttgcatgggtgggtctgactgagaaagaagcgaaagagaaaggcatcagctatgaaaccgccaccttcccgtgggctgcttctggtcgtgctatcgcttccgactgcgcagacggtatgaccaagctgattttcgacaaagaatctcaccgtgtgatcggtggtgcgattgtcggtactaacggcggcgagctgctgggtgaaatcggcctggcaatcgaaatgggttgtgatgctgaagacatcgcactgaccatccacgcgcacccgactctgcacgagtctgtgggcctggcggcagaagtgttcgaaggtagcattaccgacctgccgaacccgaaagcgaagaagaagtaatttttcgtttgccggaacatccggcaattaaaaaagcggctaaccacgccgctttttttacgtctgcaatttacctttccagtcttcttgctccacgttcagagagacgttcgcatactgctgaccgttgctcgttattcagcctgacagtatggttactgtcgtttagacgttgtgggcggctctcctgaactttctcccgaaaaacctgacgttgttcaggtgatgccgattgaacacgctggcgggcgttatcacgttgctgttgattcagtgggcgctgctgtactttttccttaaacacctggcgctgctctggtgatgcggactgaatacgctcacgcgctgcgtctcttcgctgctggttctgcgggttagtctgcattttctcgcgaaccgcctggcgctgctcaggcgaggcggactgaatgcgctcacgcgctgcctctcttcgctgctggatcttcgggttagtctgcattctctcgcgaactgcctggcgctgctcaggcgaggcggactgataacgctgacgagcggcgtccttttgttgctgggtcagtggttggcgacggctgaagtcgtggaagtcgtcatagctcccatagtgttcagcttcattaaaccgctgtgccgctgcctgacgttgggtatctcgtgtaatgactggtgcggcgtgtgttcgttgctgaaactgatttgctgccgcctgacgctggctgtcgcgcgttggggcaggtaattgcgtggcgctcattccgccgttgacatcggtttgatgaaaccgctttgccatatcctgatcatgatagggcacaccattacggtagtttggattgtgccgccatgccatattcttatcagtaagatgctcaccggtgatacggttgaaattgttgacgtcgatattgatgttgtcgccgttgtgttgccagccattaccgtcacgatgaccgccatcgtggtgatgataatcatcattgtcatgatgatgatggtcatgatcgtcgtcgtcccagtcgatgctgctgaatagtgcgtacgtggtagcaacgcccatgctatagccgaatccgcgtacaaagctgtcaacaaacggttctccggctggtggtggcagataaaccggcggatacgcagtattggcccagttcccgtaaaccacggttgggttgtagttgggaatatagaccacatcaggattggcgggctcaatggaaatgacggttgttgccggctctgtaatgacggggttggcagttaaaactgtattggatggtatgacgggtgccgtgactgtctgttttaccggtacagctttcttcgttgtggtaataactttctgttcggttgatgacttcagcgagccggtttgttgcgccagttgccgcaatcgctgtaccgagtccatcacgtcctgcggctgggccagaaaagcatcgcccaggttttgcacccattgcgggttttcgcccatcaatgccatcaattgtggaaaggccaccagtgatttaacgctggcgtcccacggctggtcagataccgcctgaatagcagcatcgccttgtttaagtggattatcgtgcgaccattgcactgcttgagcaacgtttgtcggataggttgatgccatcagcacctgcgaaagtagggcgtcgggatacagcgcgacgggcgcgacccattgatctatttgtgcagtgctgaatgcggatttgacgacggcgggtgttacgggaggtgcggaaaccgttgcaggaaacgtaaccgcggcagcgtcagacacagccagttgtgtcgattgcggttccacaggcgcttccactgtgcggctttttatatatagcccggtagaggcggcacaaagcccggcactgcaaattagcgccagcacatggggtttaaacggcaaagtcattttcataattcggatctcaaggaaatcgcaatggtcggcgaactgccacccgcaggtgctgtgaatccgagtataaagaggcggtagtttaaattttgactaatcttgggattcgttgagaaaggtgattatcaccatgcgaattaacgaagtttttacggagggaaacaatctctagaccatccttaacgattcagccacttttttatgttgcttttttgtaaacagattaacacctcgtcaaaatcctgctattctgcccgttgcggtactgggcatttaccctacaaactgctgtctcacaggagcgtgaagagaatcgcctgccgcactatgacaatgagagcgaggagaaccgtcgtgctagaagaataccgtaagcacgtagctgagcgtgccgctgaggggattgcgcccaaacccctggatgcaaaccaaatggccgcacttgtagagctgctgaaaaacccgcccgcgggcgaagaagaattcctgttagatctgttaaccaaccgtgttcccccaggcgtcgatgaagccgcctatgtcaaagcaggcttcctggctgctatcgcgaaaggcgaagccaaatcccctctgctgactccggaaaaagccatcgaactgctgggcaccatgcagggtggttacaacattcatccgctgatcgacgcgctggatgatgccaaactggcacctattgctgccaaagcactttctcacacgctgctgatgttcgataacttctatgacgtagaagagaaagcgaaagcaggcaacgaatatgcgaagcaggttatgcagtcctgggcggatgccgaatggttcctgaatcgcccggcgctggctgaaaaactgaccgttactgtcttcaaagtcactggcgaaactaacaccgatgacctttctccggcaccggatgcgtggtcacgcccggatatcccactgcacgcgctggcgatgctgaaaaacgcccgtgaaggtattgagccagaccagcctggtgttgttggtccgatcaagcaaatcgaagctctgcaacagaaaggtttcccgctggcgtacgtcggtgacgttgtgggtacgggttcttcgcgtaaatccgccactaactccgttctgtggtttatgggcgatgatattccacatgtgccgaacaaacgcggcggtggtttgtgcctcggcggtaaaattgcacccatcttctttaacacgatggaagacgcgggtgcactgccaatcgaagtcgacgtctctaacctgaacatgggcgacgtgattgacgtttacccgtacaaaggtgaagtgcgtaaccacgaaaccggcgaactgctggcgaccttcgaactgaaaaccgacgtgctgattgatgaagtgcgtgctggtggccgtattccgctgattatcgggcgtggcctgaccaccaaagcgcgtgaagcacttggtctgccgcacagtgatgtgttccgtcaggcgaaagatgtcgctgagagcgatcgcggcttctcgctggcgcaaaaaatggtaggccgtgcctgtggcgtgaaaggcattcgtccgggcgcgtactgtgaaccgaaaatgacttctgtaggttcccaggacaccaccggcccgatgacccgtgatgaactgaaagacctggcgtgcctgggcttctcggctgacctggtgatgcagtctttctgccacaccgcggcgtatccgaagccagttgacgtgaacacgcaccacacgctgccggacttcattatgaaccgtggcggtgtgtcgctgcgtccgggtgacggcgtcattcactcctggctgaaccgtatgctgctgccggataccgtcggtaccggtggtgactcccatacccgtttcccgatcggtatctctttcccggcgggttctggtctggtggcgtttgctgccgcaactggcgtaatgccgcttgatatgccggaatccgttctggtgcgcttcaaaggcaaaatgcagccgggcatcaccctgcgcgatctggtacacgctattccgctgtatgcgatcaaacaaggtctgctgaccgttgagaagaaaggcaagaaaaacatcttctctggccgcatcctggaaattgaaggtctgccggatctgaaagttgagcaggcctttgagctaaccgatgcgtccgccgagcgttctgccgctggttgtaccatcaagctgaacaaagaaccgatcatcgaatacctgaactctaacatcgtcctgctgaagtggatgatcgcggaaggttacggcgatcgtcgtaccctggaacgtcgtattcagggcatggaaaaatggctggcgaatcctgagctgctggaagccgatgcagatgcggaatacgcggcagtgatcgacatcgatctggcggatattaaagagccaatcctgtgtgctccgaacgacccggatgacgcgcgtccgctgtctgcggtacagggtgagaagatcgacgaagtgtttatcggttcctgcatgaccaacatcggtcacttccgtgctgcgggtaaactgctggatgcgcataaaggtcagttgccgacccgcctgtgggtggcaccgccaacccgtatggacgccgcacagttgaccgaagaaggctactacagcgtcttcggtaagagtggtgcgcgtatcgagatccctggctgttccctgtgtatgggtaaccaggcgcgtgtggcggacggtgcaacggtggtttccacctctacccgtaacttcccgaaccgtctgggtactggcgcgaatgtcttcctggcttctgcggaactggcggctgttgcggcgctgattggcaaactgccgacgccggaagagtaccagacctacgtggcgcaggtagataaaacagccgttgatacttaccgttatctgaacttcaaccagctttctcagtacaccgagaaagccgatggggtgattttccagactgcggtttaaaaagtcagcgcacgcgctgcgcataaacgacacaatgcccggtgaatgagattcccgggcatttttttatttctaaaccatcgccgttccgctgtttttctccggtaaggctgcgataattacatcaatggcgcaatgcgatttcggtgcattgccgggagcagaggaacacactatggattacgaatttctgcgcgatattaccggagtggtaaaggtgcgtatgtccatggggcatgaagtggtcgggcactggtttaatgaagaggtgaaagaaaacctggccttgcttgatgaagtggaacaagcagcgcacgcactgaaaggtagcgaacggtcctggcaacgggcagggcatgaatacaccctgtggatggacggtgaagaggtgatggttcgcgccaatcaactggaattcgctggcgatgaaatggaagaggggatgaactactacgacgaagaaagcctgtcgctatgcggcgttgaggattttctgcaggtcgtggcggcttaccgcaatttcgtgcagcagaagtaaataaatctggcggagcctgggagctccgccagagccgttaaacagctggcatattgcgcccgtaataaatctcgcgcatttctttccacagcgcagcggtaatttcctggcgctcgctgtcggttaagtcttccggtttggtgtggaacatgtagtgcttaaggtcgaactctttaagcaacatcttggtatggaagatattttcctgatagacgttcacatccaccatgtcatacagcgccttcatatcgtcagacataaagttctgaatcgaattaatctcatggtcgataaagtgcttcataccgttaatgtcgcgggtaaaaccgcgcacgcgataatcaatggttacgatatcggactcaagctggtggatcaggtaattcagcgccttcagcggagaaatcacgccgcaggtagagacttcaatatcggcgcggaaggtacataaaccgccttcaggatgactttccgggtaggtatgtacgcaaatatgacttttatcaagatgggcaacgaccgtttctggcagtgggccggggtgttctgttttgtcgatgagtttcgggtcaaccggttcttcactcaccagaatagtgacgctggcaccctgtggttcgtaatcctggcgggcgatgttaagaatattagccccgataatggaacaggtttctgacaggatttcggtcagacggttggcattatagagttcatcgatataagcaatataaccgtcgcgctcttcggcagttttggcgtagcagatatcgtaaatacaaaaactcagacttttggtcagattattaaagccatgcagtttcagttttttcaatttcttatcttctccttaggacggctgtgaagccagtgcgtcttgcagatactgaggtaaggcaaaagctgccgtatggattgccggattgtaataacggcatttcaggccagaggcgagaaaacgcgcctgaataatttcggttgagagatggcgtaaggcgtcgttatctgtcgcccatgcaaaagtcatgataccgccgtaataggtcgggatcgccgcctgataaaagccaacgtcgctgaagtaatggctgagtttgcgatggctgtcgatggcttcttcctgctgtaaaaagcagacgccgttttgtgcgacgaagataccgccaggattcaggcaacgtttgcagccttcataaaatgccgaagtgaaaaggctttcgccgggaccgataggatcggtgcagtcggagataatgacatcaaaggtctggctggtttgattaacgaaattgacgccatcgtcgatcaccagcttaaagcgcggatcgtcgtagctaccggcgttatggttgggtagatactgacggcagaacgatacgacacccgcatcgatttccaccatcgtgattgactcaacgtttttatgtcgggttacttcacgcagcatggcaccgtcgccgccgccgataatcagcacatgtttcgcgtgaccatgggccagtagcggaacatgggtcatcatctcatgatagataaactcgtcgcgctcggtggtttgtactacgccatccagcgccattacgcgaccaaatgcagcgttctcaaaaatgatcagatcctggtgatcggtcttttcatgatacagaacgttatctaccgcaaagtactgcccaaactggtcgtgtagcgtttcatgccactgttttttttcggccatgggttgatacctcctttgttaacacccgtaaaaaaagggcgcaacataatagctaacattgaccgcggatgcacggtcaatatttctacaaaaaggtatcagggattatttgacgtaggcaagcaggcttaaggaatcgcgggccagggctttgcattttttagcgacgggaatgccaatgccgctgagatcgcggtagctgtcttcaccgagggctttcatgtcgaaggtgtcgtaattactgaggtcccactggttttgctgagcgaaaaagaccagtgcgcgacgaatttgcccgttaggtaagttctggtaaccacaatcgttcttcagaaagacaaaaactgccgttaaatcggccatatcttcggcttcagactcgctgagcgcgtaactgtttgcgcagacggccatcaggctgccgaataacactgttctgaaaaacgtcttcattgcttctaccaggggcttaaagaagataaacgttagcacactgcgagcgaggcgacgaccattattgtcgattaaattgtgtctgcggcttgaccttcccgtaaggggaaggactatgctcaacgtttgattttgtttcgcctgcttaagaataaggaaataactatgcaacgtcgtgatttcttaaaatattccgtcgcgctgggtgtggcttcggctttgccgctgtggagccgcgcagtatttgcggcagaacgcccaacgttaccgatccctgatttgctcacgaccgatgcccgtaatcgcattcagttaactattggcgcaggccagtccacctttggcgggaaaactgcaactacctggggctataacggcaatctgctggggccggcggtgaaattacagcgcggcaaagcggtaacggttgatatctacaaccaactgacggaagagacaacgttgcactggcacgggctggaagtaccgggtgaagtcgacggcggcccgcagggaattattccgccaggtggcaagcgctcggtgacgttgaacgttgatcaacctgccgctacctgctggttccatccgcatcagcacggcaaaaccgggcgacaggtggcgatggggctggctgggctggtggtgattgaagatgacgagatcctgaaattaatgctgccaaaacagtggggtatcgatgatgttccggtgatcgttcaggataagaaatttagcgccgacgggcagattgattatcaactggatgtgatgaccgccgccgtgggctggtttggcgatacgttgctgaccaacggtgcaatctacccgcaacacgctgccccgcgtggttggctgcgcctgcgtttgctcaatggctgtaatgcccgttcgctcaatttcgccaccagcgacaatcgcccgctgtatgtgattgccagcgacggtggtctgctacctgaaccagtgaaggtgagcgaactgccggtgctgatgggcgagcgttttgaagtgctggtggaggttaacgataacaaaccctttgacctggtgacgctgccggtcagccagatggggatggcgattgcgccgtttgataagcctcatccggtaatgcggattcagccgattgctattagtgcctccggtgctttgccagacacattaagtagcctgcctgcgttaccttcgctggaagggctgacggtacgcaagctgcaactctctatggacccgatgctcgatatgatggggatgcagatgctaatggagaaatatggcgatcaggcgatggccgggatggatcacagccagatgatgggccatatggggcacggcaatatgaatcatatgaaccacggcgggaagttcgatttccaccatgccaacaaaatcaacggtcaggcgtttgatatgaacaagccgatgtttgcggcggcgaaagggcaatacgaacgttgggttatctctggcgtgggcgacatgatgctgcatccgttccatatccacggcacgcagttccgtatcttgtcagaaaatggcaaaccgccagcggctcatcgcgcgggctggaaagataccgttaaggtagaaggtaatgtcagcgaagtgctggtgaagtttaatcacgatgcaccgaaagaacatgcttatatggcgcactgccatctgctggagcatgaagatacggggatgatgttagggtttacggtataaaaagaccgtattcggaaatatgcccggatctctccgggcattaaactgatgacaaacgcaaatctgcctgatgcgctacgcttatcaggcctacgctagctgtgcaatccattgattttgcacaattttgtaggctggataaggcgttcacgccgcatccggcatgaacaacgcgcacgttgtcagcaatctgagcaagtcttacttcacatcatccggcagcgcataagccacaatatagtcgcccatcttcgtaccaaatgaaccgtgaccgcctgcggagatcaccacatactgcttaccattcacttcataggtcattggcgtagcctgaccacccgctggtaaacgaccctgccacagtttttcaccgttgctcatgttgtaagcgcgcaggtagttatctgccgtagcggcgataaacagcacgttacccgccgtggagattggcccgcccagcatcggcatacccatattgaacggcaccggaaccggcatcgggaacggcatactgtcctgcggcgtaccaatacgtttcttccacaccacttcattagttttcagatccagcgccgagatataaccccatgctggctgtttacatggcagaccaaatggtgagaggaacgggttgagcgtgacaccatacggtacaccgtactgtggctgaatgccggattccgtacccgtgcctttggcatctttcggctgctccatcgggttgccaggaccacgcgggatcagtttcgaaacaaacggcagtgccattgggttggcaatcgccacttcacgatttggatcaacggaaatcccgccccattcgaacatccccaggttacccgggaagaccagcgtaccctgttcagatggcggggtgaaaatgccttcatagcgcatctggtggaacatcacgcggcacaccagttggtcaaacatggtggctccccacatatccgcaccgctcaaatctttcgtcggacggaagctcagttcagaaaacggttgagttggggttacgtaatcgcctttcgctgcaccttggggaaccggtttttccggtgccggaaccaccagttcgccattacgacgatcgagcacaaaaatgttgccggttttcgccggagcgtaaataactggcactttctgaccattaacggtgatgtccgccagcgtcggctgtgccggaagatccatgtcccacaggtcgtggtgaacggtctggtagctccacgccagtttcccggtagtggcattcagcgccagaatcgagctggcataacgttcctgttccggtgtgcggttaccgccccagatatccggcgtggtcacgcccatcggcagatagaccagatccagcttcgcgtcataggccgctggtgcccaggagtttggcgagttaaaggtaaaggtgtgttcgtcagacgggattgcgttcggatctttcgcgccgggatcaaaagcccacagcagctccccggtgttgacatcaaaaccacggatcacgccagacgtttcgcgggttgagaagttatcggtaactgaaccggccatcacgatggttttatcggtgataatcggtggcgaagtcggttcatacagacccggtttggtgtctggcatattgctttgcagattgagcacgcctttattggcgaaggtttcgcacagtttgccgttttcagcgttaatcgcaatcagtcgaccatcattgaccggaagaatgatacgacgcgggcaatccgccatcacttccggcgaagcggtttctgctttggcttcatgataagagacaccacggcaggttacgtgctggaaagactcgttggttttcagctcaggatcgtaatgccatttctctttgccgctggcggcatcaagcgcaaacaggcgctggtgagcggtacacaggtaaagggtgtcgcccactttaatcggcgtcacttcattggtgatttcacccggatcgttcggctgcttcacatcgccagtacggaacacccaggcttctttcagattatggacgttatcggcgttaatttgtttcagcggcgaaaagcgttgaccttcctgattacgaccataggcaggccagtcctgatcggctacgggggagatagcttcagcaggtgtggcatcggcgcttaaggtgccgttgatctcctgcggatcgttaaatccggcccaggtcaggataccaccgctaatcagcagtgcgaccaccagtgcggcaactgcgccgctggcaggaatgaccaggcgacgccagacaaacggcaggatcagccagatgccgaagaagaccagaatgtcgctgcgcggagtcagcgcccagaagtcgaaaccaacttcccagacgccccaaatcatggtgccgagcagcagggctgcgtatagccaaagcgcggcgcgtttactgcgccacagcatccaggcgacgccgagcatcacaaggccagcgatagggtagtaccaggagccgccaatcgcgaccagccagcctccgccaatgagtagatacagcccgcaaagcgctgcaaaaagggctgttagcgtgacgagtaatcgtcgcgagcctgtattgttaattgccataaagagacaccatttcaattcattaatattttagtagcaattaattataggttttaacatgtgtgatcgtcatcacaattcgagctttattaacagattccgcgaatgaatagttttactggtatactgcgtgtcttgcgctttgttgcggtgccaaaacctgcccgtgcgaagtgatttgtttttaaatcatatggttagagatatgaaacatactgtagaagtaatgatccccgaagcggagattaaagcgcgtatcgccgaactgggtcgtcagattactgagcgttacaaagacagcggcagcgatatggtgctggtgggtctgctgcgtggctcatttatgtttatggcggacctgtgccgtgaagttcaggtatctcatgaagtcgactttatgaccgcctccagctacggtagcggcatgtccaccacccgtgatgtgaaaatcctcaaagatctggatgaagatatccgtggcaaggacgtgctgattgttgaagatatcatcgactcggggaatacactgtcgaaagtgcgtgagatcttaagcctgcgcgaaccgaagtcgctggcgatttgtacgctgctggataaaccgtcccgtcgtgaagtgaacgtcccggtagaatttatcggtttctcgatcccggatgagtttgtggtgggttacggcattgattacgcacagcgttaccgtcatctgccgtatatcggcaaagtgattctgctggacgagtaagtgtgaagttgccggatgtgttgcatccggcatggcatttttatttgtggttggcgtgtttcagcttgaggttggaaatcccgtgacggtaacgttgctcaagggtttcgcggttggtggcggtaacatccagatcacgcagcaagccgtcgtgaatgccgtaggcccagccgtgaatggtaactttctgcccgcgtttccacgctgattgcataatggtggagtggcccaggttatacacctgttccatgacgttcagttcacacaaggtatccagacggcgctcttgcggcatttcgccgagcaatgagctatgtttgaaccagatatcgcggatatgcagcagccagttgttgataagccccagttccgggttttcaactgcggcttgtacgccgccgcaaccgtagtggccacagataataatgtgttcaacttcgagtacatccactgcatactgaaccacggaaaggcagttcaggtcagtgtgaatgaccaggttagcaacattacggtgaacaaagagttcgcccggctcaagaccggttaaacgttctgcaggaacgcgactgtcggaacatccaatccatagaaagcgcggtttttgcgcttgtgccagtttctcaaaaaacccgggatcctcttccaccagcatttttgaccatagtgcattgttgctgatgagtgtatctatgtctttcatggaggttaacgacctgtaaccaaataattacgtttggctaatatagggcaactccgggacgatttaaaccacagataaagtgtaagaacgtaaggtaagtaaaaatttatgaccattgcactggaacttcaacagcttaaaaaaacctatccaggcggcgttcaggcgcttcgtgggatagatttgcaggtcgaagcgggtgatttttatgcgcttctcgggccgaacggggccgggaaatcgaccactatcggtattatcagctctctggtaaataaaacctccgggcgggtcagcgtatttggttacgatctcgagaaggatgtcgtgaacgctaaacgtcagttgggactggtgccgcaggaatttaacttcaacccgtttgaaaccgtgcagcaaattgtggtgaatcaggcagggtactacggcgtggagcgcaaagaagcgtacatccgcagcgaaaagtatcttaaacaactcgatctatggggaaaacgcaacgaacgtgcgcgtatgttatctggcgggatgaagcgccgtttaatgattgcccgtgcgttaatgcatgaacctaaactactgattctcgacgaaccgaccgcaggcgtggatattgaacttcgccgctcaatgtggggctttttgaaggatttaaacgacaaaggcaccaccatcattctcaccacacactacctggaagaagcagaaatgctgtgccgcaatatcggcattattcaacacggtgagctggtggaaaatacctcgatgaaggcgctgctggcgaagctgaaatcggaaacctttattctcgatctcgcaccgaaaagcccgttaccgaagctcgatggctatcagtatcgactggtcgataccgcgacgctggaagttgaagtgctgcgtgagcaggggatcaacagcgtatttacgcagttaagtgagcagggcattcaggtattaagtatgcgtaacaaagctaaccgtctggaagagctgtttgtttcactggttaatgaaaaacaaggagatcgcgcatgatgcatctttactgggtggcgctaaaaagcatctgggcgaaagagatccatcgctttatgcgtatctgggtgcagacgctggtgccgccagtcatcaccatgaccctttactttattatcttcggtaacctgattggttcgcgtattggcgatatgcatggcttcagctatatgcagttcatcgtaccggggctgatcatgatgtcggtgatcaccaatgcctacgccaacgttgcgtcatcattttttggtgccaagttccagcgtaatattgaagagctgctggtagcgccggttccgactcacgtcattattgccggatatgtcggcggtggcgtggcgcgtggtctgtttgttggcattctggtgacggcaatttcactgttttttgtgccatttcaggtgcattcgtgggtattcgttgccttaacgctggtgctcacggcggtgttgttctcccttgcgggtttgctgaacggtgtgtttgccaaaacgttcgatgacatcagcctggtgccaacctttgtgttaacgccactcacgtatttgggcggggtcttttactcactgactttgttgccgccgttctggcaagggctgtcgcacctgaacccaatcgtttatatgatcagtggtttccgctacggcttcctcggtatcaatgatgttccgctggtcactacctttggcgtactggtggtctttattgtggcgttttatttgatctgttggtcgctgatccaacgtggacgtggtttgcgtagctaaggctatttcctctcctctggatttgggggagaggagttttgacggctatcaccctttatcaacaatggtcagggtagactgattttcggctaaggaggaaggcgatgttaggttgggtaattacctgtcacgatgaccgggcgcaagagatactggatgcgctggagaaaaaacatggggcacttcttcagtgccgggccgtgaatttctggcgcggattaagctctaatatgctcagccgcatgatgtgcgatgctctgcatgaagcggactctggtgagggtgtcatcttcttaaccgatatagccggagcgccaccgtatcgcgtggcttcattattaagccacaaacactcccgttgcgaagtgatttctggtgtcacgttaccgttaattgaacagatgatggcttgccgtgaaaccatgaccagttcagagtttcgcgagcgtattgtcgaactgggtgcgccggaggtgagtagtctttggcaccaacaacaaaaaaatccgcctttcgtcctcaaacataatttgtatgagtattaacccgcgattctgatggcgcttttgctacaataaaagcgttgtttcaccctcggttattttttcatgtacaaacaagctgttattctcctgctgatgctgtttaccgcaagtgtcagtgccgcgttacctgcccgttatatgcaaaccatcgaaaatgctgcggtctgggcgcaaattggtgacaagatggtgaccgtggggaatattcgggccggacaaatcattgccgtggagcccactgccgcaagttattacgcatttaattttggctttggcaaaggttttatcgataaaggtcatctcgagccggttcaggggcgacaaaaagttgaagacggtttgggcgacctcaacaagccgctgagtaatcagaacttagttacctggaaagatacgccggtctataacgcgccgagtgcgggaagtgcgccatttggggtactggcggacaatttgcgctacccgattttgcataaactgaaagacaggttaaatcaaacctggtatcagatccgtattggcgatcgactggcctatatcagcgcactggatgcccaacccgataatggcctgtcggtgctaacctatcaccatattctgcgcgacgaagaaaacacccgttttcgccatacttcgacgaccacatcggtacgcgctttcaataaccagatggcctggctgcgtgacaggggatacgcgacactgagcatggtgcagctggaaggctacgtgaagaataagatcaatctccctgcgcgagcggtggtgattacctttgatgatggcctcaagtcggtgagccgctatgcgtatcctgtgttgaaacaatatggcatgaaggcgacggcgtttattgttacctcacgcatcaaacgtcacccgcagaagtggaacccaaaatcgctgcaatttatgagcgtttctgagcttaacgaaattcgcgatgtatttgatttccagtcacatacccattttttgcatcgggtagatggttatcgccgacccatattactgagccgtagtgagcacaatattctgtttgattttgcacgttcacgccgcgctctggcgcaatttaatccgcatgtctggtatctttcgtatccgtttggcggatttaatgacaacgccgtgaaggcagcaaacgatgccggatttcacctggcggtgacaaccatgaaaggcaaagtaaaaccgggggataatccgttgttactaaaacgactttatatcttaagaacggattcgctggagacgatgtcgcggctggtgagtaaccagccgcagggataacaatcaagcaacctgtaccggaatcgctttcgcggtacgtttcatttcattgtcgccttcaaaataggcgacgttgggtcgccaggtgcgagcttcttcatctggcatggtaacgaagctggcgatgatgacaatatcgccgacactggcgcagtgggccgccgcaccgttaacagaaataattctcgaaccgcgttctgccgcgatggcataagtggagaaacgcttgccgttggtgacattccagatatcaatggcttcgttttcgagaataccggctgcgtcaagaaaatcctggtcaatggcgcaagaaccttcatagtgcaggtccgcatgagtcactttcacgcggtggagtttgccctgcagcatcgtgcgaatcataacttctacctttctaccctgtcgttaacgaagcaggcgatgcctgctttgaggaaattctcacgcagtattgcccgatttttgtttagtgtctactcatctgacggcatttgcgtcagcagtttgcgtaccgcgccgaagcgtgccatgtatcgcctgtaacgaattgatatttctctgaacgctgctcggtaaacaataaagaggtggctgacgatagcgcgccttgactggatactgccttcacgcaaagccacacggaagacagggaagatggatgcaccgagtaccacaccgcatgacgcggtatttaaacaatttttaatgcatgcggagacggctcgcgactttctggagatacatttgccagtggaattacgcgaactttgtgacctcaacacgcttcatttagagtcggggagtttcattgaagagagcctgaaaggacacagcacggacgtgctctattccgtgcaaatgcagggcaatcccggttatctgcatgttgtgattgaacaccaaagcaagccggataagaaaatggcctttcgcatgatgcgttattctatagccgccatgcaccggcatctggaggctgaccacgataagctgccgctggtggtgccgatactgttttatcagggcgaggccacaccttatccgctatcaatgtgctggtttgatatgttttactcgccggagctggcgcgacgcgtctataacagtcctttcccgctggtggatatcaccatcacaccggatgacgaaatcatgcaacatcggcggattgcgattctcgaactactgcaaaaacatattcgccagcgcgacttaatgttattgcttgagcaactggtcacgctgatcgacgaagggtacactagcggaagtcagttagttgccatgcaaaactatatgctgcaacgcggtcatactgaacaagcggatttgttttacggtgtgttgagagacagggaaacgggaggggagtctatgatgacgctggcgcagtggtttgaagagaaagggattgagaaggggattcagcagggaagacaggaagtaagtcaggaattcgcccagcgtcttctgagtaaaggaatgtctcgggaagacgttgcagagatggcaaatttacctcttgctgagattgataaggtaattaaccttatttaagttacctgtgttatgacagatgacgtggggtaaattaataactggcgccatcagccgtagcgccagttaagtattacgccagctcgaccattttgttgtcgatcaggcgagcatcgccaagccaggcggctaccagaattactgcccgtttgctggtttcagaaacttccagcaatgtgtcggcatcgcgaatctgaatatcatcggcgcggaagcctttttcattcagttcttgccccgcaatggtaataatttcatcgagatcccgttccccagcctgcaatttgtcagcaatcgaacttaaaactttgtacagaccaggcgcaattttgcgttgttccgccgtcagataaccgttacgggaacttagcgccagaccgtctttggcgcgcataattggcacaccgacaatctcaatatcgaagcccatatcggcaaccattttgcggatcagcgccagttgctgaaaatctttttcaccgaagcaggcgatgtccggctggaccaggttgaacagcttgctgacaatagtcgaaacgccgcgaaaatgtcccggacggctggcaccttccagcatggtcgaaaggccaggaacgtcaacgtaagtgtgggtttcagtaccgttcgggtagatctcttttaccgaaggggcgaaaactaaatccactttacgtttgtttagcttctcgcagtcctcctgcaaggtccgtggataacgagccagatcttccgggcggtcgaactgcatcgggttaacgaaaatactgacgacgaccacatcggcgcgggctttggcttcgtcgaccagcttcatatggccatcgtgcaggttacccatggtaggcaccagcgccacgcgcttgccttccatacgcaggcggcgaatttgctgacgcagcagcggcagggtttcgataattaacacaacgtgactccttaatggaaactgtgttcttcgcccggataaacgccggactccacttcagccatatactgccgcacagccgcgcggatgtcgcccgtttcggcgaggaaatttttagcgaatttaggaatgtgaccgccggtaataccaaaggcgtcgtgcatcacgaggatctgcccgtcagtgacgttgcctgcgccaatgccaataaccgggatcgccagtgcttcggtaatacgttttgccagttcaaccggcacgcattccagcaccagcagctgtgccccagcagcttctaaggctaatgcatcgctgagcagttgatcgcccgcttcatcgccgcgcccctgaactttgtagccaccgaaaatattcactgactgtggtgttaaacctaagtgaccacatacaggaacggcacgttcggtcagcatttgtacggtttctaccagccactcaccgccttcaattttgaccatgttagcaccggcacgcataaccgttgcggcgttttcgaaggcttgttccggcgtggcatacgccataaacggcaggtcagccagcagcaggcagtttggtgcgccgcgacgtacggcggcagtgtggtaggcgatatcggcaacggtaactggcagggtggagtcgtgcccctgaaccgtcatgcccagcgaatcgcccaccagcatgacgttaagcccttcatcagcaaagagtttggcgaagctatagtcataagcggtgatggtcgcgaaacgttttttttcctgtttgtacttctgcagtaaggagatggtggtcggtttcataacgtatcctgataaattgatgttgtgctgtctggcattttatcagtcacattggtgggggcaatgatttatccgtagcagcactgccagaaggtgacagtgctgctacgttatcagggataggttacctggaaagtactggtggctttaaattcgccgggttcgatagcaatattcccgtcttgctttaatgttgcctggaaatgaagaggctgtgatgtgccgttaccttgattagggtaaaccccatcggaggtgtcatcttcggtttcataatctatataaacagaattcgtatcattaggttttaatgtcattagcggatttttactggttgctaaaccttcaatgagtacgccaacgcctttggcggcagtgcttccagtaagcgtattaccaagcagttgtgtgttttgagtacctacttttccagtgacgagttttgtttcaatattacgcacacgaatacaattctgaagcgagatatcaaagggaacaggtgaagcgccatttttaattgtcccagagctatattctcccattctaaccgttgaaccattgactgatggcccggtaagtatggaggtaaaacatgttggtaaggttaatttgacattattcagtgtgaaattgacataaatgtggttgctgtgatctacaacttttgtaccaggactgtaggccttaaacgaataaaggtaatttgatgaactggataactggacttgctgattaagtgtaggatcgaaattagtatctgtataaaattcaacagttatgttgtgtactataccaccaatagcccaaaacttatcgtagtcgtctgctttgttgcaacccttagtttgtagatcgctgtctgtgacggaaaagaaaaattcttggttggaaggatctccgatatagattcctggcgattgaatgtcagttattgtatcgtatgcagaccagacccttgatattaacatggtgtaatacagaccaggaacagatgtattaaatagtttatgtccgccataatctttacctgaatagaccatggcattttcaatagttattggaccaggattcgctctgccagatgtattgcagtaaagaataccaccaccggtacctgtatccaggtatgaccagtacatttttaccccagtcgggccgagctgcgtgggtttataaaaaaccaagttgcttgctgttgatgtgtaattaaaggtcatctgtgcggcagtggaggggcctcgatagttatcaactcctgcattatttcccacaataaaacttgtatatgcactgactgtattacaacaagaatacagtgctaaaaaaagaatgtacctgaagatagtcttcatttttactccaatgtttctttattgttatggtttgcgctgtttttgtttgttattcgtagtaaatatccactaacacatggctcataagttgaccagatgtaacactcaatgcaggatcgattttttgcattcgggtgctaaatttccaggatgaaccattcatgtcatccgacattactggataaacggaacgagatccgcctgaagcattaagaacattgaatgtattcgccgaatcctgagtagaaaatataactactcctacattacttgctcctgacgaaatttcattagcaaatatttgcctagagccagcagccatgacaccgctaagggctctaaaatcaatatgtaactgatttagcacatcgccagttccctgtaatgcacagtcggatacagtgatagtgaactcttttccacctggttgataactttcaggagtaacattacctgaaaaatatcccaccccaacgacgccaagatcaatattaccctggttactgattccgcttttgcaggtgctgttttttacattggcaacaaggtcaatatcctgtccagcaatggctggacaggcgatgcaaaacagtaatgacagaaacagaattattctcttcatcagcttacgttgagtgggatgcatatatagttcctgaatctgtaagtctgttagttataggttactgtaaatgtggctggtgcagaaaacttacccgcagtgacattgtttacggttttatttttttccacgaccaggcgtgcactcatcggataataaacgaccgcattggctgcagtggagattgttacctcttgtgatgctggtgttacacagctaaattgtgttgcactccctgttgccggagttacagtgctccagacttcaacggcgacagcacttgctttatctgcggctgtggaaccatttgcaaaccccgcaccgtcattagcagttccctcgcatgtggctcgcttggttaattttatttgcgcttttttattggggatacccgcacagtctttgaatttgagtttgaatgtttttactttggtcttggcattgatttcagaaatatatacatcaccaaaatcaacaacagaaatgtcctgatcagagtcatttactaatgtagcggtacaagtacccatttctacagtagtaataacggtcagtccaatactgtctgttgccgcataagagagtacgctgaacaatgaggcagccaaaacgacactgctggataatccataacgtaaatttttaaatgtcatcataattatccttcttattgatagatgaaattaaacgtcgccagtgcacgaaaattccccggtacgccttgccctgcatctgtttcacgtagcgcaacggtcatttcaagacccttatcgggctgcatctcgtctgtgctccagcgtatcttttccgcactgttaggtttaaggaaagtggcatcatcagtagtccgttttttgaaacccataccgatattacttgtcgtcgaagatgaatcaccagactgcggtataataagcttaggtgagcttgatgatgcatttccggtcagagtggtatcaatccaactgatgccactgctgcacccactggcaaccagtttaaaatcagcctgagattctgtcgttttattcgcgatcttatccagacccatcttagggattctcaatgtgtagttattattgccatcattcgtgacgttattaccagtaagtgtgatgttacaggttgtcgctttgacagtggctgtaaactctacattaatatccgttgcaaatactgagggtgataataatattcccatcagtatcactattttatgtggcgttgtttttatcatttgacgtcccttgtagttactgaatctgacaccgaattccattcagaataatagattgtgctattttttctgcttctgggctttgttgataatgcgcaagacaacttacgggtttactttgttcgagccatttaatgctgatatttccctgctgctcaataccacgaacaaatgcttgtccaccctgtccaacattaccaatgacattgccttgctcatcataaatatctgcagcaaatggaatatttttaccatcacttcgtgtgatgttcataatggctgattgcccttgcacggtttcaaaatcagcaaagacgactgaaccctgacgcggtacagctactgcactggtactttttaattcaacatcgttctcaagatcgttgatatccagcgcgatacggttttcatgataaggagaaagagcgctggtgacaccataaccccatcgatcgatagtactgttgccataatttattcgcgctccttgagcacctggagcctgaactaccgccagtgtatcggagtcgctaaaactatcattactgaaagtcagtccaccgctatgcaatacaaaaccaccgtcggtgctgagagaaacttgacggctgttatcgctatttgcagaaattgaacctgccagcgttccccatggtgactcatagctggcataacccccaacataactcaaatctttgctggctttattcatcgtatagccagtattcacgctataactgacgcgagcgttatcgctatagccactgctgctaacgttgagttggttattacccttaaagtcactgcttatttgagtatcaatactctggaaacctgaagtacgttgttcagtgccaagtaatttttcaattggaatggtgaaactaagataaacgctatcgtcagtgtcgccgtcttcattccatgaacgctgggcactgacactgtagctgccccaggatgtactgttactgtagccaatagagtaattgctacgattttgtccggaagcccagtaatcggaccaacttccggaaagataaaatgaaccgtaatcttttttctcaaatttcaacggttggttaatactgaccgtaacctgatttttcatgcgtgagtaattacgcatggatttcggttcaagatcttgttcgggatgtttcacttcatcaattagagttagtgcatcattaagaccaaggtaattctgtgtcgaatagcgataggccgcgatattcagtgaagtacttgtttcttcgaataacttgttccaggaaacacgataactttgcccctggtatgttttatcatccgggatacgaacattggaatgagtcacatcgaaagaaaatgcaccaactgaagtattcagaccaagacctaacaaaccagcggtatagttattatcggttatctgaataccggtataacccgtcagatagttattcaggccgtagtagtagcttgcttgaaataaattaggctcatcctgaatatcatcttttaagacctgaccgccgctaatatcccaacgtccaacgccagggcgtaacatttgaacaacggatgagaaaggttgcgagaatgtccgctttgagccatcggattcttcgatggtaacaataagatcgctgccgtaccctgacggactcagatcatcaatgacgaaagcgcctggcggcaccgtcgtttcataaatcttatagccaccttgcgtaatagtgactttggcgttggtattggcaacgccatgaatgataggcgcaaagctggctaaagtcggaggcaacatgcggctgtcactgtataaacgaatgcctcggatactgacggaatcaaaggtttcgcccgtcgtataagactcaccaagaatgagttgagaacgcagcgaggcgatatcacgctgaacataccgattcttaaaatcataattactgccagaatcggtcatccagttgtagttgcccgaggcacgcagtcgccatgcacctaaattcatcccaccgttaaatgcagcataaatgctttcattttttcgaccaggggtttcactatgatatccgttgaggttgtatgacaacatggccgcattaatgccgttttcccataacgatggatcaacatagttttggtaatttttcattacccaggcttgaggaacgtctatatccagacgttgatcgttaacgtcataacgaacagaagcctgagggataatttccgtcaaattgaggcaattgccgagcgtttcatccctggcaagcagaacggctttttcgttatttatatcgggagaattaatatgaaactgcaataaattctttaatgtgatacaagcctgggcgttcttttttccttcaattgcgacaaatgtaatactttggttaatgattggttggtcgtttacataaacactgacgtcgtaaacacccggtatagcggggttaccttcactgtaccggctgagatcaatattagatgcattctgccccatcaggaaggtatggtcatattcaacgagttcagcactgaaagcagtattgcaatacagcagcgcgcaaaacgtggcgatacgggtcagatgatgataatttttagtatattctatagtcacgctatgcttcctgcggaattatatccttgcctgattacagcctggcattaccttcaattgcgccaccaaagtcattaatggcgtaaaaatgcacttttgcagaattcgctttgccattaaggccattgactttcatgacctcatcactaaatggtgcaatcattttcacatcaatcggatagcgtttaccgctagcttctaaatcaccactgctaaaagagacgtagtaaggggttggattggtcactcgtaatgacgccttaccttctgaacctgaccagaaccacttcagggctaacggggcttcagagggatttcccttcaatccatccgggcgatagaaaagttttatacgtgtgcgaaatgccagttgcagcaggctttgattcgcgaccttttctgcatctggttttggtggaacttccagtacgttaaaccagaacacgctctctctgtctttaggcagtgaggtgctggctgtgtacattaatttgattgtttgcccacgtttggcatcaatacgcgatactggcggcgtagcagtaaaagggactgtaatactgccaggctcagcgttgtcatcgccagtatctaaccaactctggacaagcaacgggttattccctttattttccagacgtacgttgacacttttttgatcgcttttatatattacgcgagtacccgaaatgacaatgtccgcaatagacgatgaactaaaagccatacaggttacgaagcataaagctgttgtatgtttggtgttaaaaaacataaaccatccctgatagagttaattaaaacagggaataatataaaatagaaattattattccctgtatattcattcaatcaatttaactggtgaatacttactgataagtaatggtgtatgcagtgttagtttttacataaccagcagttgctgtttggtctgcgacggcacgaacgtaagacgctttaaaatcataaacagcagattttgtcgttgcatccagggctttagtatacacatcgccagggttgttaatttgaacctgtttgatagtggaaccatcaatattgtgtagagcgatattaacgccgtcagatgggttgttaatagacatgtcgttgttcaaagtccctttgctgttaccaaagaaaacagaaccgaaggtcattttagccgtgctacctggattcggatttgctttgctgcagtcaacggtgatgctgaaaggtttagctttagcgccaacggtgtcattcagtacgccagcatcgatttcaccaacggttgcggtttgcagcaggatcagaccatccttgttaccgccgtcaacgcgggtttcacaggtgttatcaacaaccagaccactgatatttaactgaccgccgtccatatcagcagaagcagtacctgcaaccatcgccagcataagaccagacagggcaaaacctaattttttagacataaaaatcctttaataaaattccattagtcagactacatgtttgaagaatgactattcatgacacaaataggagaaacaaatgttagatattaatgagcaatgatatttgttacccaaatttacaaccattgttcattaggtcgcctattgtgcactttagaagcttttgaacaaattaaatttacttaattcaaaattaagtaaaaataagttcacaagtgcaattggttagggtatggagatgggattgatatttatttataggaagttatattatttccgcaaagagatgtttaaactaaaatcgtaattaaggaaagagatgagatatgattttcagaaaatatttatattcgcaatataaataaattaccatttgtttaatttgtcaaatgctcttgtatgtaagatttgacgcaacatctccccatcaggaaacaccaactccggcgcgatttcaaacagcggccacagcataaatccacgattcttcatatcgtagtgcggaacggtcaggcgttcagtatttatcacttcattaccaaacagcatgatgtcgagatccagcgtgcgtggtccccagcgttcagctttgcggacgcgaccttgctgcaattcaatacgctgtgtgtgattgagtagctcttcaggtgcaagagaggtttccagcgccacggctgcgtttaagtaatcgggttgatcttgcggccccagcggtggggtgcggtaaaacgaagaaacggtaagaatgtggctttcagggatatcgcctaatgctttcagggcagcattgacctgctccagcggagaggccagattgctgcctatggcaatatacgccactgtcatgcggtaccctcacgacgtggtgcgcgtttgcgtggacgacgagtacgacgacgcggtgacggttcttcatccagctcgttgagcatccctttttggtctggtggcgcggaaacctggaactcaccccaccatttcaccagacgctgcagttcagcgttacgctcaacttcagctcgcaaggccaacaggtcataagccgcacggaacttaggatgctccagcagtttccatgcgcgtttaccctgacgacgggacatacgcaactgcaactgccagatatcgcgggttaatgtcgtcagacgtttcgggattgccagtgaacggcaggcttcgtccagcacgtcgttcatcgccagcgcgaaagcgtcgtgataggtcaggccgctttcctgggcgatcttctgtgccgtctccagcagtgggtaccagaacatggcggcaaacaggaacgccgggttcacgcgcatatcgttatggatacgcgtatcggtattcttcagcacctgttcaatgatccgctccatcgggctgtcgccattttccgtgaagtagcgggtaatggtcgggaacagcggctggaacagatgatattcacacaacagcttataggtttcgtaaccgtagcccgcttgtagcagtttaagcgattcttcaaacaggcgtgccggtgggatatcgttcagcagggtagcgaggcgagggatcggttctgcggtttccgggctgatgcgcatacccaatttggcggcaaaacgtaccgcgcgcagcatacgtaccggatcttcacggtagcgcgtttccgggttaccaatcagacggataacgccgtccttcagatccttcatgccgccaacgtaatcacggacggtaaaatccgctacgctgtaatacaggctgttgatagtgaaatcgcggcgctgggcgtcttcttcgatggagccgaaaatgttgtcgcgcagcaacatgccgttttgcccgcgttgggaggtcgtgcggtcgctgacgttaccttcgtggtgtccacggaaggtcgcaacttcgataatctccgggccaaacattacatgagccagacggaaacggcgacccaccaggcggcagttacggaacagtttgcgcacctgctcaggcgtggcgttagtggttacgtcaaaatctttcggctttttgccaagtaacaggtcgcgcacgccgccgccaaccagccaggcttcgtatcccgctttattgagcctgtacattaccttcagggcattttcactgatatctttgcgggaaatagcatgctgctcacgcgggatcaccgtcacctgtggacgggcgactgcctgttcagcctcgctttcctcgcggcttagcaccttgcggcaaaaattagcgactcgggtaaaaatagtacacctcggtagtgtcaaacatcattcaggacaaaaaaatagcggctaatcatagctcagcatgacgcatttgagaatgttgaatttacaattgccgactcgggcacggcggtaagccgccagtttttgacggctgactgaaggatttgctcgacgctgaaatcctgccagtgtgcttctgcctgctgccccagaaattgaagtgccgcgattagtaccgggcgtggatcgcctttcggcaacgcaggcgcatgattctgcttggaaagtttagcgccttgtggattaagcgccagcggcagatgaatgtaatctggcactttccagccaaaaagctggtacagcgagatttgccttactgttggttcaatcagatcagccccacgcactatttctgtaacgccctggaaatgatcatcaaccacaacagccaggttgtaggcgaacaacccatcacggcgatgaatgataaaatcttcccgtgccagtttttcgtcggcgtgaataatgccgcgcagctggtcagtaaattgcgtgaccggatgctgctggcggatacgcactgcggcgttgtctggtccatgatgcaacacccggcaatgaccgtcgtaaataccgccaatgctttgaatacgcgcacgcgtacaggtgcagtaataacttagtccttgttcatgtaaccaggcgagtgcttcacgataggcgtcgtgacgttgcgattgccagagaacatcgccgtcccagtgcagaccgtaatgttccagctggcgcaggatagtttctgcggcaccgggaacttcacgaggcgggtcgatatcttctatgcgtaccagccagcgaccttgccgggcgcgagcctgcaaatagctgccgagcgcggcgatcagagagccaaaatgaagctcgccggaaggagagggggcgaagcggccaatatactgtgtgtctgtcatctctttgaacaaaaaataaggcgggagcatttcccgcctgtggtaaacgtgatggaacggctgtaattagccagccatctgtttttcgcgaatttcagccagcgttttgcagtcgatgcacagatcggctgtcgggcgcgcttccagacggcgaataccaatttcaacaccgcaggattcgcagtagccgaaatcttcgtcttccacttttttcagcgtcttctcgatctttttgatcagcttacgctcgcgatcgcggttacgcagttcgaggctgaactcttcttcctgggctgcacggtctaccgggtccgggaagttggctgcttcatcctgcatatgtgtaacggtgcgatcgacttcatccctgagttgattacgccatgcttccagaatacgacggaagtgcgccagctgggcttcattcatatactcttcgcccggcttctcctgatatggttccaccccagcgatggcgagaatactcagggacgatgttttacggttttgcccttcttgcatgttgcttctccttaacacgcactatcgatccccatgttcgggggaaaaatgaggccgctataaatagcagatgcttttccggatagcaattatctaaacgtaacacttgacaactgtgtgaggaaaagcgtatttgcgcacgcgaccagaatgtaaattaaccagttacttactttactacaatgtaaccggcagtgattttttaagagccatgccttcagcagaaatttccgctttgtaagccagaatttctacccccctctgttgagcttctgacaatagttgcgcgtatttctcatcgatgtggcgcgcgggtgaaaaccgtgtaatggctgaatgcagcacggcgaaaaagataaccgcacgctggccttcagccgctacgctcatcaactcccgaaggtgtttctgacctcgttcagtgaccgcatcgggaaaatatccctgttcgttctccgctaacgtaaccgatttcacttcaatatagcagtctggacgcgaatccgcctgcaacataaagtcaatacggctgcgttctgcgccgtattttacttcgcttttcagcgagctatagcctgacagttctgaaattgattcattaaggatagcctctttcgtcaacctgttagcccaaagcgtgttgacgcaaataaatgcgccgctctggctttgagttaattcccaggtgtgtgggtatttccgtttggtgttgtctgaagtcgaataccagacggtatcgccaggcgttgcacaaccggtcatcgcacccgtattcgggcagtgtagcgttaattcgcgaccatcgggtgtgatcacatcggctaaaaaacgtttgtaacgctgaattagcgtcgcgcgctgtagagggggagaaaattccattgcgacaatccttgttattgcgttagcgcccagcgttttagcggcgtgtagcgtgtgcgtccacgggcaaacgaggaggcgtaaagggtgaactccgtcaccgcatacgaccagttaaaacctggcggcgggattgtcaccgcctcgctggcgtcgcgcaataaggtaatatgtggatgaaacggacgattgctttgaaaacaaccgctgcgggcagcctgtgaacggagcatattcgccagctggattaagccgcgtggcggctgacgcatccctaaccacaccacacgcgaacgcagccattgtccggcgtcatcaagcgtgagtgtgaaaccaggttgacgaatccgtccggctaaaagagaaagcgccttctctttctcggcgctcacttcgcctaaaaatgccagagtcagatgcaaattatcggcggcgaccggacgtcccgcctcaggtgggaagtgtgtggcgcgccaatggataatctgttcgcggatttctgcaggtaagtcgatagcaaagaacagacgttgcggttcagacatgtgaggcactcggttatgaattaccgcgatgctacaatgtggcgcgaagaatgttaaccctctggagcgttttgtgtcgtcgttgcccgttgctgccgtcttacctgaattacttaccgctctcgattgtgcgccgcaggtattattaagtgcgccgaccggggccgggaaatcaacctggctgccgctgcaactgctggcgcatcccggcattaacgggaaaattatcctgctggagccgcgtcgtctggcggcgcgtaacgtcgcgcaacggctggcggagctgcttaacgaaaagccaggcgataccgttggctaccggatgcgtgcgcaaaactgcgtcgggccgaatacccgcctggaagtggttaccgaaggcgtgctgacgcgcatgatccagcgtgacccggaactgagcggtgttggactggtgatccttgatgaatttcatgagcgcagcttgcaggcggatttggcgttggcgctgttactcgatgtgcaacaaggtctgcgtgatgaccttaaactgctgattatgtcggctaccctggacaacgaccgcttgcagcaaatgctgccagaagcgcctgtcgtcatctcagaagggcgctcgtttccggttgaacgccgttatttaccgctgcccgcgcatcagcgttttgacgatgccgttgcggtagccaccgctgaaatgctgcgtcaggaaagcggatcattactgttatttttacctggcgtcggagaaattcagcgtgtgcaggaacaactggcttcgcgcatcggcagtgatgtattgctctgcccgctgtatggcgcgttgtcgctgaacgatcagcgaaaagcgatcctcccggcaccgcaagggatgcgcaaagtggtgctggcgaccaatattgctgaaaccagtttaaccattgaaggtattcgtctggtggtggattgtgcccaggagcgtgtggcgcgttttgatccgcgcacggggcttacgcgactgattactcaacgcgttagccaggcatccatgacgcagcgtgccgggcgcgccgggcgtctggagccgggtatcagcctgcatttaatcgccaaagaacaagcagaacgcgccgcggcgcaaagtgaaccggagatcttacaaagcgatctttccggtttgctgatggaattactgcaatggggatgcagcgatccggcgcagatgagctggctggatcaaccgccagtagtgaatctactggccgcgaaacgtctgttacaaatgctgggggcactggagggtgaacggcttagtgcgcaagggcaaaaaatggcagcgctgggtaacgatccgcgtttagcggcaatgctggttagcgcgaagaacgacgacgaagctgctaccgcggcaaaaattgccgccattctcgaagagccgccacggatgggcaatagtgacctgggcgtggcgttttcgcgcaatcaaccagcctggcagcaacgtagtcagcaactgttaaaacgcttaaacgtacgtggcggtgaggcagacagttcgcttatcgcgccgctacttgccggggcgtttgccgatcgcattgctcgtcgccgtgggcaagatggacgctatcaactggcaaacggcatgggagcgatgctcgatgccaacgacgcgctaagccgccacgaatggttgatcgcaccgttattattgcagggcagcgcctcgccggatgcgcggattttactggcgctgctggtcgatattgatgagttagtacaacgctgcccgcagctggtacagcagtctgacactgtggagtgggatgacgcgcaaggtacgctgaaagcctggcgtcggctacaaatcggtcagttgacggtgaaagtgcagccgctggcgaaaccgtcagaagacgagttgcatcaggcgatgcttaatggcatccgtgataaaggtttaagcgtgctcaactggacggcggaagcggaacagctacgcttgcgtttgttatgcgccgcaaagtggttgccggaatatgactggccagcggttgatgatgaaagtttattggcagcgctggaaacgtggctgctgccacatatgactggcgtacattcactacgcggcctgaaatcactcgacatttatcaggcactacgcggattacttgattggggaatgcagcaacgtctggatagtgaattgcctgcgcattacactgtgccgacgggaagccggatcgccattcgttatcatgaagataacccgcccgcgctggcggtgagaatgcaagagatgtttggcgaggccaccaatccgacgatcgcccaggggcgcgtgccgctggtgctggagttgctttcacctgcccaaaggccattacaaatcacacgagatttgagcgacttctggaaaggagcgtaccgtgaggtgcaaaaagagatgaaagggcgttatcccaaacatgtctggccggacgacccggcaaatactgcaccgacgcgacggacgaaaaagtattcgtaaggttggttttctccctctccctgtgggagagggccggggtgagggcatcagcgcgcacgttcaccctcaccctaaccctctccctcaagggagaggggaccgatcgagcacaaattttgagagatatcttcttctgtcttgtaacagaagaacagaaaatcgggcttttgcgcctgaatattgcggagaaaaagcatggccgggaatgaccgcgagccaattggacgcaaagggaaaccgacgcgtccggtcaaacaaaaggtaagccgtcgtcgttacgaagatgacgatgattacgacgattatgatgactatgaggatgaagaaccgatgccgcgcaaaggtaagggcaaaggcaaagggcgtaagcctcgtggcaaacgcggctggctatggctactgctaaaactggctatcgtttttgccgtgctgatcgccatttacggcgtttatctcgatcaaaaaattcgtagccgtattgatggcaaggtctggcaactgcctgcggcagtttatggccgaatggtcaatcttgagccagacatgaccatcagcaagaacgagatggtgaagctgctggaggcgacccagtatcgtcaggtgtcgaaaatgacccgtcctggcgaatttaccgtgcaggccaacagcattgagatgattcgccgtccgtttgatttcccggacagtaaagaaggacaggtgcgcgcgcgtctgacctttgatggcgatcatctggcgacgatcgtcaatatggagaacaaccgtcagttcggtttcttccgtcttgatccgcgtctgatcaccatgatctcttcgccaaacggtgagcagcgtctgtttgtgccgcgcagtggtttcccggatttgctggtggatactttgctggcgacagaagaccgtcatttttacgagcatgatggaatcagtctctactcaatcggacgtgcggtgctggcaaacctgaccgccggacgcacggtacagggtgcgagtacgctgacgcaacagctggtgaaaaacctgttcctctccagcgagcgttcttactggcgtaaagcgaacgaagcttacatggcgctgatcatggacgcgcgttacagcaaagaccgtattcttgagctgtatatgaacgaggtgtatctcggtcagagcggcgacaacgaaatccgcggcttcccgctggcaagcttgtattactttggtcgcccggtagaagagctaagcctcgaccagcaggcgctgttagtcggtatggtgaaaggggcgtccatctacaacccgtggcgtaacccaaaactggcgctggagcgacgtaatctggtgctgcgtctgctgcaacagcaacagattattgatcaagaactctatgacatgttgagtgcccgtccgctgggggttcagccgcgcggtggggtgatctctcctcagccagcctttatgcaactggtgcgtcaggagctgcaggcaaaactgggcgataaggtaaaagatctctccggcgtgaagatcttcactacctttgactcggtggcccaggacgcggcagaaaaagccgccgtggaaggcattccggcactgaagaaacagcgtaagttgagcgatcttgaaactgcgattgtggtcgtcgaccgctttagtggtgaagttcgtgcgatggtcggaggttctgagccgcagtttgcgggctacaaccgtgcgatgcaggcgcgtcgttcgattggttcccttgcaaaaccagcgacttatctgacggccttaagccagccgaaaatctatcgtctgaatacgtggattgcggatgcgccaattgcgctgcgtcagccgaatggccaggtctggtcaccgcagaatgatgaccgtcgttatagcgaaagcggcagagtgatgctggtggatgcgttgacccgttcgatgaacgtgccgacggtaaatctggggatggcgctggggctgcctgcggttacggagacctggattaaactgggcgtaccgaaagatcagttgcatccggttccggcaatgctgctgggggcgttgaacttaacgccaatcgaagtggcgcaggcattccagaccatcgccagcggtggtaaccgtgcaccgctttctgcgctgcgttcggtaatcgcggaagatggcaaagtgctgtatcagagcttcccgcaggcggaacgcgctgttccggcgcaggcggcgtatctgacactatggaccatgcagcaggtggtacaacgcggtacgggtcgtcagcttggggcgaaatacccgaacctgcatctggcagggaaaacagggactaccaacaataacgtagatacctggtttgcgggcattgacggcagcacggtgaccatcacctgggtcggccgtgataacaaccagccgaccaaactgtatggtgccagcggggcaatgtcgatttatcagcgttatctggctaaccagacgccaacgccgctgaatcttgttccgccagaagatattgcagatatgggcgtggactacgacggcaactttgtttgcagcggtggcatgcgtatcttgccggtctggaccagcgatccgcaatcgctgtgccagcagagcgagatgcagcagcagccgtcaggcaatccgtttgatcagtcttctcagccgcagcaacagccgcaacagcaacctgctcagcaagagcagaaagacagcgacggtgtagccggttggatcaaggatatgtttggtagtaattaacatctaagcgtgaaataccggatggcgagttgccatccggtaaaataacatcccatctaagatattaaccctttcttttcatctggttgtttattaacccttcaggaacgctcagattgcgtaccgcttgcgaacccgccagcgtttcgaatattatcttatctttataataatcattctcgtttacgttatcattcactttacatcagagatataccaatggcgcgttccaaaactgctcagccaaaacactcactgcgtaaaatcgcagttgtagtagccacagcggttagcggcatgtctgtttatgcacaggcagcggttgaaccgaaagaagacactatcaccgttaccgctgcacctgcgccgcaagaaagcgcatgggggcctgctgcaactattgcggcgcgacagtctgctaccggcactaaaaccgatacgccgattcaaaaagtgccacagtctatttctgttgtgaccgccgaagagatggcgctgcatcagccgaagtcggtaaaagaagcgcttagctacacgccgggtgtctctgttggtacgcgtggcgcatccaacacctatgaccacctgatcattcgcggctttgcggcagaaggccaaagccagaataactatctgaatggcctgaagttgcagggcaacttctataacgatgcggtcattgacccgtatatgctggaacgcgctgaaattatgcgtggcccggtttccgtgctttacggtaaaagcagtcctggcggcctgttgaatatggtcagcaagcgtccgaccaccgaaccgctgaaagaagttcagtttaaagccggtactgacagcctgttccagactggttttgactttagcgattcgttggatgatgacggtgtttactcttatcgcctgaccggtcttgcgcgttctgccaatgcccagcagaaagggtcagaagagcagcgttatgctattgcaccggcgttcacctggcgtccggatgataaaaccaattttaccttcctttcttacttccagaacgagccggaaaccggttattacggctggttgccgaaagagggaaccgttgagccgctgccgaacggtaagcgtctgccgacagactttaatgaaggggcgaagaacaacacctattctcgtaatgagaagatggtcggctacagcttcgatcacgaatttaacgacacctttactgtgcgtcagaacctgcgctttgctgaaaacaaaacctcgcaaaacagcgtttatggttacggcgtctgctccgatccggcgaatgcttacagcaaacagtgtgcggcattagcgccagcggataaaggccattatctggcacgtaaatacgtcgttgatgatgagaagctgcaaaacttctccgttgatacccagttgcagagcaagtttgccactggcgatatcgaccacaccctgctgaccggtgtcgactttatgcgtatgcgtaatgacatcaacgcctggtttggttacgacgactctgtgccactgctcaatctgtacaatccggtgaataccgatttcgacttcaatgccaaagatccggcaaactccggcccttaccgcattctgaataaacagaaacaaacgggcgtttatgttcaggatcaggcgcagtgggataaagtgctggtcaccctaggcggtcgttatgactgggcagatcaagaatctcttaaccgcgttgccgggacgaccgataaacgtgatgacaaacagtttacctggcgtggtggtgttaactacctgtttgataatggtgtaacaccttacttcagctatagcgaatcgtttgaaccttcttcgcaagttgggaaggatggtaatattttcgcaccgtctaaaggtaagcagtatgaagtcggcgtgaaatatgtaccggaagatcgtccgattgtagttactggtgccgtgtataatctcactaaaaccaacaacctgatggcggaccctgagggttccttcttctcggttgaaggtggcgagatccgcgcacgtggcgtagaaatcgaagcgaaagcggcgctgtcggcgagtgttaacgtagtcggttcttatacttacaccgatgcggaatacaccaccgatactacctataaaggcaatacgcctgcacaggtgccaaaacacatggcttcgttgtgggctgactacaccttctttgacggtccgctttcaggtctgacgctgggcaccggtggtcgttatactggctccagttatggtgatccggctaactcctttaaagtgggaagttatacggtcgtggatgcgttagtacgttatgatctggcgcgagtcggcatggctggctccaacgtggcgctgcatgttaacaacctgttcgatcgtgaatacgtcgccagctgctttaacacttatggctgcttctggggcgcagaacgtcaggtcgttgcaaccgcaaccttccgtttctaatttctcttttggggcacggatttccgtgcccatttcacaagttggctgttatgcaggaatacacgaatcattccgataccacttttgcactgcgtaatatctcctttcgtgtgcccgggcgcacgcttttgcatccgctgtcgttaacctttcctgccgggaaagtgaccggtctgattggtcacaacggttctggtaaatccactctgctcaaaatgcttggccgtcatcagccgccgtcggaaggggagattcttcttgatgcccaaccgctggaaagctggagcagcaaagcgtttgcccgcaaagtggcttatttgccgcagcagcttcctccggcagaagggatgaccgtgcgtgaactggtggcgattggtcgttacccgtggcatggcgcgctggggcgctttggggcggcagatcgcgaaaaagtcgaggaagctatctcgctggttggcttaaaaccgctggcgcatcggctggtcgatagtctctctggcggcgaacgtcagcgggcgtggatcgccatgctggtggcgcaggatagccgttgtctgttgctcgacgaaccgacctcggcgctggatatcgcccaccaggttgatgtgctgtcgctggtgcaccgtttaagtcaggagcgtggcctgacggtcattgccgtgttgcacgatatcaatatggcggcacgctactgtgattatctggtcgccctgcgcggcggtgaaatgattgctcagggaacgcctgcggaaattatgcgcggcgaaaccctcgaaatgatttatggcatcccgatgggtattttgccgcatccggcgggtgctgcacctgtgagttttgtttattgatgagcggcttacctcttatttcgcgccgtcgactgttaacggcgatggcgctttctccgttgttatggcagatgaataccgcccacgcggcggctattgatcccaatcgtattgtggcgctggagtggttgccggtggaattactgctggcgctcggcatcgtgccttacggcgtggcggataccatcaactatcgcctgtgggtcagcgaaccaccattgccggactcagtgatcgacgtcggtttgcgcacagaacctaaccttgaactgctgaccgaaatgaaaccatcgtttatggtctggtcggcaggatatggcccttcaccagaaatgctggctcgtattgcgccgggtcgcggatttaacttcagtgacggcaaacagccgttggcgatggcgcgtaaatcgctgacggaaatggcagatttacttaacctgcaaagcgcagcggaaacgcatttagcgcaatatgaagactttatccgcagcatgaaaccccgctttgtgaagcgtggtgcgcgtccgttattgctgacgacgcttatcgatccgcgccatatgctggtcttcggtccaaacagcttgttccaggaaattcttgatgagtacggcatcccaaatgcctggcaaggggaaaccaacttctggggcagtaccgccgtcagtatcgatcgtctggcggcgtataaagacgttgatgtgctctgttttgatcacgacaacagcaaagacatggatgcgctaatggcaacgccgctgtggcaggccatgccgtttgtccgcgccggacgctttcagcgcgtacctgcagtctggttttatggtgcgacgctctcggcaatgcactttgtgcgcgttctggataacgccatcggaggtaaagcgtgagtaaacgaattgcgcttttcccggcgttattgctggcgctgttagtgattgtcgctacggcgctcacctggatgaacttctcgcaggcgctgccgcgtagccagtgggcgcaggctgcctggtcgccggatattgacgtcatcgagcagatgatttttcactacagcttgttgccgcgtctggcgatttcgctgctggtgggcgcgggtctggggctggtgggcgtgctgtttcagcaagtgctgcgtaacccgctggcggagccgacgacgcttggcgttgctacaggcgcgcaactggggattaccgtcactacgctctgggcgatccctggtgcgatggcgagccagtttgctgcgcaggcaggggcttgtgttgttggcttaattgtctttggcgtcgcgtgggggaaacggctgtcgccggtaacgctgattctcgcggggttggtagtgagcctttattgcggcgcaatcaatcagttactggttatcttccatcatgaccaactgcaaagcatgtttctgtggagcactggaacgctgacgcaaaccgactggggcggcgttgagcgtttatggccgcagctgctgggcggtgtgatgctgacgttgctgctacttcgtccgttaaccctgatggggcttgatgatggcgtggcgcgcaatctcgggctggccttgtcgcttgcgcgtctggcagcgctgtcgctggcgattgtcatcagtgcgctgctggtgaacgctgtggggattatcggctttatcgggttgttcgcgccgctgctggcaaaaatgctgggggcgcggcgtctgctgccacgactgatgctggcgtcgttgattggtgcgctgatcctctggctttccgatcaaatcatcctctggctgactcgcgtgtggatggaagtgtccaccggttcggtcactgcgttgatcggtgcgccgctgctactgtggctgttgccgcgtttacgcagcattagcgcgccggatatgaaggtcaacgatcgtgtcgcggctgaacgccaacatgtgctggcgtttgccctcgcgggcggcgtgctgctgttgatggctgtggtggtggcgctgtcgtttggtcgtgatgcgcacggctggacgtgggcgagcggggcgttgctcgaggatttaatgccctggcgctggccgcgaattatggcggcgctgtttgcgggcgtcatgctggcggtggcgggctgtattattcagcgactgaccggaaacccgatggcaagcccggaagtgctggggattagctccggcgcggcgtttggcgtggtgttgatgctgtttctggtgccgggtaatgcctttggctggctgttacctgcaggcagtctcggcgcggcggtgacgctgttgatcattatgatcgccgccggccgcggtggattttccccacaccgtatgttactggcggggatggcgttaagcaccgcgttcaccatgcttttgatgatgttgcaggcaagtggtgacccgcgaatggcgcaagtgctgacctggatttccggttcgacctacaacgcgaccgatgcgcaggtctggcgcaccggaattgtgatggtgattttgctggcgattaccccgctgtgccgccgctggctgaccattttaccgctgggtggtgataccgcccgagccgtaggaatggcgctgacgccgacgcgaattgcgctgctgctgttagcggcttgcctgacggcgaccgcgacgatgactattggaccgttgagttttgttggtttaatggcaccgcatattgcgcggatgatgggctttcgacggacgatgccacacatcgtaatttcggcgctggtgggtggtttactgctggtgttcgctgactggtgtgggcggatggtgctgtttccattccagatcccggcggggctgctgtcaacctttatcggcgcgccatattttatctatttgttgagaaagcagagccgttaatttttccatataacggccctgtacgcctggacggataaagcgtttacgcgacaacggatgcccgatgcgacgctggcgcgtcttatcgggcctacaaacggccccgaatcgtaggtcggataaggcgttcacgccgcatccgacaaaccatgctggatcacaacttcgcaaacacccgacgtgcagcatcgatggtgttattgatatcttccatgctgtgcgccacggacataaagcccgcttcaaacgctgacggtgccaggtaaacaccttcgtccagcatcatatggaagaaacgcttaaagcgttccacgtcacaggccatcacatcctgatagcacgtcacggactcggcgtcggtaaagaaaataccgaacatgccgccaacgtggttaacgaccagcggaattccggcttcttctgccgcttccagcagaccttctgccagacgtgttgtcagctcatccagcgtttcgtgaacgcccggctgcgcgacttcattcagacaggcgaaacccgctgccatcgcaatcgggttaccggaaagcgtacccgcctgatagaccggacccgtcggggccagcgcatccattacatcacgacgaccaccgaatgcgcctaccggcattccaccgccgatgattttgccgaggcaggttaaatctggcactacgccgtaataatcctgtgcgccagctagcgctacgcggaaaccggtcatcacttcatcgatgatcagcaacgcgccaaattcgtcgcacagcgcgcgcagacctggcaggaactctggcagcggcggaacacagttcatattgcctgccaccggctcgacgataatacaggcaatctcttgcgggtattgctcaaatgcggcgcgtacagaagccagatcattataagtacaggttaaggtatatttggcgaaatctgccggaacgcccggcgagtttggctggcctaacgtgagtgcgccagaaccggctttcaccagcaggcagtcagcgtgaccatggtaacacccttcaaatttaataattttgtcgcgaccggtaaaaccacgggccaggcggatggcgctcatggtcgcttcagtgccggagttcaccatgcgcaccatatccatggtcgggaccagttcggtcaccagttgcgccattttcacttccatttcggttggtgcaccaaagcttaaaccacgctcggcggcttcaatcacggcattgcggattgccggatggttatggcccagcaccatcggcccccaggaaccgacataatcgatataggctttgccatcaacatcgtacagataagcgccgtccgctttttcgataaacagtggagtgccgcccacgccagtaaaggcgcgaacaggggagttcacaccgccagggatcagctcgcgcgctgcgctgtaaagattttcagacttactcatggagggttcctgattcgtagaaaaagtgaatggctgctattctatgttattcataacaagttaaatactcgtcaaacatcaggctgcttgtactggtgcaatcctgatttcttagagtataaaagttttgtgcatttgaaacattacgctttgcaaaggattttcatggaacgtgcgagtaaaatgccgtcatcttatttgtatgaccaataagtgatcattggatgaaaactgatactccctctttagaaacaccgcaggccgcgcgcctgcgacgcagacaactgattcgccaacttcttgagcgcgataaaaccccgttagccattttgtttatggcggcagtcgtcggcacgcttgttgggctggcagcggttgcttttgacaaaggtgtcgcctggttgcagaaccaacgtatgggggcgctggtacatactgctgataattatccgcttctgttaaccgtcgcttttctctgttcggcggtgctggcgatgtttggctactttttggtgcgcaaatacgcgccggaagcaggtggttcggggatcccggaaattgaaggggcgctggaagatcaacgtcccgttcgctggtggcgtgtattgccggtgaagttctttggcgggctggggacactcggcggaggcatggtgttggggcgcgaagggccaaccgtgcagatcggcggtaacattggccgtatggtgcttgatattttccgcctgaaaggtgacgaagctcgccatacgctgctggcaaccggtgctgctgcggggctggctgcggcctttaacgcgccgctggcgggtattttgtttattatcgaagagatgcgtccgcagtttcgctatacgttaatttcgattaaagcggtatttattggtgtcattatgtcgaccattatgtaccggatttttaatcatgaagttgcgttgattgacgtcggtaaactttctgatgcgccgcttaatacgctgtggctttatctgatcctcggtattatttttggcattttcggccctatttttaataaatgggtgctggggatgcaggatttgctgcaccgtgtgcacggcggcaatattaccaaatgggtgctaatgggcggtgcgattggcggtctgtgtggattgctggggtttgtggcaccagcaacgtcgggcggcggttttaacctgattcctatcgctaccgcggggaatttcagcatgggaatgctggtgtttatcttcgtcgcgcgggtcattaccaccttactctgcttctcttccggcgcgccgggcggtatttttgccccgatgctggcgctgggtactgtgctgggaaccgctttcggaatggttgccgttgagctgtttccgcaatatcaccttgaggcggggacgtttgctattgccggaatgggggcattactggcggcatctattcgcgcgccgttaacggggatcattctggttctggagatgaccgataactaccagctcattttgccaatgattattaccggtcttggcgcaacactattagcgcaatttaccggcgggaaaccgctatactcggcgattcttgcgcgcacgctggcaaaacaggaagctgagcaactggcgcgaagcaaggccgcatcagccagcgagaatacttgaacgaaataccagggtattagataatggcgattattattgggttagaatttgcccaattgccgatgtcgtttggagcaaaatatgagtgatgacgtagcactgccgctggagtttaccgacgcagcagccaacaaagttaaaagcctgatcgctgacgaagataacccgaatctgaaattacgcgtgtatatcaccggtggcggttgcagcggcttccagtatggtttcacctttgatgatcaggtgaacgaaggcgatatgaccatcgaaaaacagggcgttggcctggtggttgatccgatgagcctgcaatatctggtcggcggttccgttgattataccgaaggtctggaaggttctcgtttcatcgtgaccaacccgaacgcgaaaagcacctgcggttgcggttcttcctttagtatctaatctgttgttcatgtgccggataaactatccggcacatcttctctcttcaacgcccattctcatccagcgcaaacgtcggtagcttaagatgccaacgaatagccgccagccgaatcaatagcgtcacgaccatgcccatcatactggctgtttccagtggtacggaaaatgtgtaataagccgtagcgtggacaataccgccgataatacaggcagttgcgtagatttctgtacgtaaaatcatggggatttcgcgggccagaacatcacgaatgatcccgccgccaacgccagtaatgacgcccatacaaaccgcgattaacggaccggcttccgcattaaaggctttattcacgccaatgccgacaaacaccgccagaccaacggcgtccagcaccggcaacatccattttggtaagcgtcttggctggcgcaccagcacgatggtcagcatgctggtgaccattgcaacgaccagatcggtgggatctttcacccaaaataccgggccgtgatccagcgccatgtcgcgaattgtcccgccgcctactgcggttaccacgcccagtaccagaacaccaaaagggtccatacgcaattttccggctaacaaaacgccggagatggcaaataccgctgtgccgactatatccagccaatagacgagcattgttcaatccccactgagcacctgaaaaggtcaggcgctaatctacctgtgaaagcgcattacagagctgttgtgcagcgaggataatacgtgggcttgcacgttcaaaccagtcactcgtgagaggaataacgggaattttgagctgttcaccccagtattgtttgattttaggaatttggtccggtccgcctgtaatgacaatcgcctgtggcgagcgtgctaacacctgttcgcggctaacttgcggccagggaacccggctgtctttaaagatgttttctccgccacaaacttcgagtacctggttctgaatcgactcttttccactggtaaatggcggattaatgccgaattgcagaaaaacacgttttttaggtttatcagcatattgcgctttcaattgcgcgtactgatccagcagggattgcgcggcttgttcggccttgtctggttgcggactccagggggccagttgacgtaacgcattggcaatttgttcaatgcttgtcgcatcgacccacatcacttttattcccagcgaagccagctggtcaacctgccgctcggcattacctccacgccaggcaatcaccagatcgggtttcagcgcgacaatgcgttccagattcatcccctgccaggtggaaacctgctcaatcttttgcgcttgtggaggatagtcggaatagctgctgaccccaaccggcgtgatcccggcggcaaaggcaagttcagtgttggcgggagaaagcgtgatgacgcgcggcgcggcgttgagccacagtggcgcaagaaaagacagggcgaccagcgccctgaacagtgacttagccatgtgcaagtttctgcaccagtgactcaaccatcaggctggactgtttagcggcaacagccaggaactcatcgaagctaagatgagactgttgatcggccacgtcggagatggcgcgtacgacaacaaacgggacgttgaaattgtggcagacatgggcgattgccgtcgcttccatctctacagcaatggcctgtgggaagttgtggcggattttcgccagaccaacagaaccgttgatgaaagcgtcgccgctaacaatcaggccacgtacagcgttaagattcagttcggcaatgcaggcctcagcggcagcgatcagtttatcgtcagctttaaagcctgccggacagcctggtaactgaccgtattcataaccaaatgccgtgacatccgcgtcgtgataacgtgcttcgtccgagacaacgatatcgcccactttcaacgttggtgccaggccaccggcagaaccggtgttaataatcacatctggcttgcagtgttccaacagcaaagtggcacccagcgccgcagcgactttaccgatgcccgatttcagaagcgcaacctcggttccattcagttggccggtatagatttcgcaaccgccgagactgatagtttgacggttttcgattttgtcacgcagcagcgtaacttcttcttccattgcaccaatgatgccgattttcatagatttactcgcgataagcccgatttgaaggcatagtttaccatgcgcttacggggaagcgtatttctcacgcgggagaggacatggcacagattgatttccgaaaaaaaataaactggcatcgtcgttaccgttcaccgcagggcgttaaaaccgaacatgagatcctgcggatcttcgagagcgatcgcgggcgtatcatcaactctccggcaattcgtcgtctgcaacaaaagacccaggtttttccactggagcgcaatgccgccgtgcgcacgcgtcttacccactcgatggaagtccagcaggtggggcgctacatcgccaaagaaattttaagccgtctgaaagagcttaaattactggaagcatacggcctggatgaactgaccggtccctttgaaagcattgttgagatgtcatgcctgatgcacgatatcggcaatccgccgtttggtcattttggcgaagcggcgataaatgactggtttcgccaacgtttgcacccggaagatgccgaaagccagcctctgactgacgatcgctgcagcgtggcggcactacgtttacgggacggggaagaaccgcttaacgagctgcggcgcaagattcgtcaggacttatgtcattttgaggggaatgcacaaggcattcgcctggtgcatacattgatgcggatgaatctcacctgggcacaggttggcggtattttaaaatatacccgtccggcgtggtggcgtggcgaaacgcctgagacacatcactatttaatgaaaaagccgggttattatctttctgaagaagcctatattgcccggttgcgtaaagaacttaatttggcgctttacagtcgttttccattaacgtggattatggaagctgccgacgacatctcctattgtgtggcagaccttgaagatgcggtagagaaaagaatatttaccgttgagcagctttatcatcatttgcacgaagcgtggggccagcatgagaaaggttcgctcttttcgctggtggttgaaaatgcctgggaaaaatcacgctcaaatagtttaagccgcagtacggaagatcagttttttatgtatttacgggtaaacaccctaaataaactggtaccctacgcggcacaacgatttattgataatctgcctgcgattttcgccggaacgtttaatcatgcattattggaagatgccagcgaatgcagcgatcttcttaagctatataaaaatgtcgctgtaaaacatgtgtttagccatccagatgtcgagcggcttgaattgcagggctatcgggtcattagcggattattagagatttatcgtcctttattaagcctgtcgttatcagactttactgaactggtagaaaaagaacgggtgaaacgtttccctattgaatcgcgcttattccacaaactctcgacgcgccatcggctggcctatgtcgaggctgtcagtaaattaccgtcagattctcctgagtttccgctatgggaatattattaccgttgccgcctgctgcaggattatatcagcggtatgaccgacctctatgcgtgggatgaataccgacgtctgatggccgtagaacaataaccaggcttttgtaaagacgaacaataaatttttaccttttgcagaaactttagttcggaacttcaggctataaaacgaatctgaagaacacagcaattttgcgttatctgttaatcgagactgaaatacatgaaaaaaaccacattagcactgagtgcactggctctgagtttaggtttggcgttatctccgctctctgcaacggcggctgagacttcttcagcaacgacagcccagcagatgccaagccttgcaccgatgctcgaaaaggtgatgccttcagtggtcagcattaacgtagaaggtagcacaaccgttaatacgccgcgtatgccgcgtaatttccagcagttcttcggtgatgattctccgttctgccaggaaggttctccgttccagagctctccgttctgccagggtggccagggcggtaatggtggcggccagcaacagaaattcatggcgctgggttccggcgtcatcattgatgccgataaaggctatgtcgtcaccaacaaccacgttgttgataacgcgacggtcattaaagttcaactgagcgatggccgtaagttcgacgcgaagatggttggcaaagatccgcgctctgatatcgcgctgatccaaatccagaacccgaaaaacctgaccgcaattaagatggcggattctgatgcactgcgcgtgggtgattacaccgtagcgattggtaacccgtttggtctgggcgagacggtaacttccgggattgtctctgcgctggggcgtagcggcctgaatgccgaaaactacgaaaacttcatccagaccgatgcagcgatcaaccgtggtaactccggtggtgcgctggttaacctgaacggcgaactgatcggtatcaacaccgcgatcctcgcaccggacggcggcaacatcggtatcggttttgctatcccgagtaacatggtgaaaaacctgacctcgcagatggtggaatacggccaggtgaaacgcggtgagctgggtattatggggactgagctgaactccgaactggcgaaagcgatgaaagttgacgcccagcgcggtgctttcgtaagccaggttctgcctaattcctccgctgcaaaagcgggcattaaagcgggtgatgtgatcacctcactgaacggtaagccgatcagcagctttgccgcactgcgtgctcaggtgggtactatgccggtaggcagcaaactgaccctgggcttactgcgcgacggtaagcaggttaacgtgaacctggaactgcagcagagcagccagaatcaggttgattccagctccatcttcaacggcattgaaggcgctgagatgagcaacaaaggcaaagatcagggcgtggtagtgaacaacgtgaaaacgggcactccggctgcgcagatcggcctgaagaaaggtgatgtgattattggcgcgaaccagcaggcagtgaaaaacatcgctgaactgcgtaaagttctcgacagcaaaccgtctgtgctggcactcaacattcagcgcggcgacagcaccatctacctgttaatgcagtaatctccctcaaccccttcctgaaaacgggaaggggttctccttacaatctgtgaacttcaccacaactccatacatcttcatcatcctttaggcatttgcacaatgccgtacgttacgtacttccttatgctaagccgtgcataacggaggacttatggctggctggcatcttgataccaaaatggcgcaggatatcgtggcacgtaccatgcgcatcatcgataccaatatcaacgtaatggatgcccgtgggcgaattatcggcagcggcgatcgtgagcgtattggtgaattgcacgaaggtgcattgctggtactttcacagggacgagtcgtcgatatcgatgacgcggtagcacgtcatctgcacggtgtgcggcaggggattaatctaccgttacggctggaaggtgaaattgtcggcgtaattggcctgacaggtgaaccagagaatctgcgtaaatatggcgaactggtctgcatgacggctgaaatgatgctggaacagtcgcggttgatgcacttgttggcgcaggatagccgtttgcgggaagaactggtgatgaacctgattcaggcagaggagaatactcccgcacttactgaatgggcgcaacggctggggatcgatctcaatcaaccgcgagtggtggctattgttgaggtcgacagcggtcagcttggcgtggacagcgcaatggcggagttacaacaactgcaaaacgcgctgactacgcccgagcgtaataatctggtggcgattgtctcgctaaccgaaatggtggtgttgaaaccggcgttgaactcttttgggcgctgggatgcagaagatcatcgtaagcgagttgaacaactgattacccgcatgaaagagtacggccagctgcgttttcgcgtttcactgggcaactattttaccggtcctggcagtattgcccgatcctatcgtacggcgaaaacgacgatggtggtgggtaaacagcggatgccagaaagtcgctgctatttttatcaggatctgatgttacctgtgttactcgacagtttgcgtggcgactggcaggccaacgaactggcgcgaccgctggcgcggctgaaaacgatggacaataacggcttgctgcgacgaacgctggcggcgtggtttcgccacaatgtgcaaccgctggcaacgtcaaaggcgttgtttattcatcgtaataccctggagtatcggcttaatcgtatatcggaactgaccgggcttgatttgggcaattttgatgacaggttgctgctgtatgtggcgttacaactggatgaagagcggtaggttatgcgttaaggttgaggcggcgctggctcattcccctcagcccgaagggtagaggggaatgcccgaattaaccgtcagttcgggattatttacgcgttagtttttccagatcggcttcaatctcgctgatcttattggttacgactgactccaggtgacgtaagtcgtcgaggatcttacgcttaagatcaacttcgctgcggtcacgctggcagatttgatcaagctcatcaatgatataccgtagattcgggctgatttcctggacttctttataaccctgacccacaccatcagcgacgaccgttttacgctgacgcggatatttaaacttaacgctcttggcgaaaaactcgcctttgtctttctggaaatagattttcagaatatcgttgttggcttcctgccggaggctgtaacgatcaatttcttcaggattggtaatacccagacttttcagattgtcgtacatagcgttacctcaaaatgagtcagtaaattgtgcttattttagcatttggcctggcccgcccggctcgactgtgatcgcagaaagcctttttcttccagacttctatcatggcgtaaaaatcaaaaaattacctgctttattctggtgataaaattcacgatctacaccagttccagcatcgttacttccgggcggcagttcagacgcaaaccatacaaactgcccacgccacgggttgtgtagatgtgtctttcgccaaaggcatttaatccggcgacgtaacgtttatcttcgacaggggcaaaaggttcaccaaccaacggtacgcgcagttgcccgccgtgagtatggccgcacagcatcagatcccagggttcatcacgcatgacttctttgctgtcgggattatgcgccagcaccagtcttggcagattggcttcgctggcgggaggcggtttgcattgtccggcccataagtcaccagtgcctaccagttcgaattgcctgttcggcgtggcgatcaccgtagcctggttaaacaacaccgtgatgcccgctgatttcaacgtctcgccaattaagtgatttttttctgtaccaacagggcgatcgtggttgccgaagcaggcaaacgtcggcgcacattcggcaaggggggagagtacgtcactaaacgccgaaaaattcagcgacatatcaaataatacgtaatcgccgcccagtaatatcaaatcgggcttttgttctatgccaagagcaatcgcgtcagaaatcaggcttaaaggaacaaaacgagagtaatggagatcggccagaaaaagaattttgaatggtgctgcgttgtctttaaaaaaggcgaggcggtgacggattaattcaaaccagcctggctcacagtaatgcatataaccgaaacctgagctcgtggctatcgtcgcggcagtagcctgcaaaaatcggcggcgtgaaatcatcgctcatccctgcaaaaaaatcgggcagcgtcgtgctgcccgtgtgcatacttttagtcgatggtacgcagcagttcgttaatgccgactttgccgcgagttttcgcgtcaactttcttaacgataaccgcacagtagaggctgtatttgccatcttttgacggcagattacctgaaacaaccacagaccccgccggaacgcgaccgtagtggatttcgccggtttcacggtcgtaaatacgggtgctctgaccaatgtatacgcccatggaaatgacggaaccttcttcgacaatcaccccttcaaccacttcagagcgcgcgccgatgaagcaattatcttcaatgatggttgggttagcctgcagcggttccagcacgccgccgatgcccacgccaccggaaaggtggacgtttttaccaatctgcgcacaagaaccgacggtcgcccaggtatcaaccatggtgccttcatcaacatatgcgccgatgttgacgtaagacggcatcagcacggtgttacgggcaataaacgcaccctgacgtaccgccgctggtggcacaacgcggaagccttctttctggaaacgtgcttcgtcgtagtcggcgaatttcatcggcactttgtcgaagtagcggctttctgccccttcgatcacctgattatcattaatacggaaagagagcagcaccgcttttttcaaccactgatgcgtcacccactgaccgtcaattttttccgctacacgcagtgcgccggaatccagcagggcgatcacctgatttaccgcttcgcgggtaacggtgtctgcattggctggcgtgatctcggcacggcgttcaaaagcggtttcaataatgttctgtaactgctgcattgttaaactcttttcatatcagtaaacacatcaccctttatcgtttggattgagggcctctgtcaaccgctgatgcacttcctgctgcaactcgttattaagcgcacgccggtcagcggtggcaattatgaataaatcttctactcgctcgccaatggttgtaattcgggcaccatgaagcgaaattcccagatcggcaaaaattttcccgactcgcgccagcagtccaggttggtcgagggcgatcagttcgaggaacgatttgcggtcggtatgggtcggcaaaaacgttacttcggtttcaacagtaaaatggcgtaatttggcgggttggcgacggggctgcggtggctgccagctactttgcgtcagtacttgctccagaccaaaccgaataacctcatgacgatctgcggacagcgggttgccatcgggttccagcacgataaaggtatccatcgccataccgtcgcgagtggtgaaaatttgtgcgtcgtgaacacttaaattgcggcggtctaattcggcacagacggcggcaaacagataagggcggtccgggctccagataaaaatctcggtgcctccacgcgtagcctgcgggctaagcaataccagcggtttgcttaaatcatgctgtaataaatggcgggcatgccaggccagttgatttgggctatggcggacaaaatagttagcacgacagcgtgaccaaatttggtgcagcgcctcttcgtcgatgttatccatgcgcagtagtgccagtgcctggagttggtgatggcgaacccgttcgcgcatatccggcgtgttttgcattccgcgtcgtagctgcttttcggtggcaaagtagagctcacgcaacagactttgcttccagctattccacagcgtttcgttggtggcgcaaatgtcagccacagtcaggcataccagatagcgcagacgattttccgtttgcacttcttcggcaaactgcttgatgacttccgggtcctgaatatcgcggcgttgggcggtcaccgacatcaacaggtgctggcgaaccagccaggcgaccagctgtgtttcgcgtgagttcagcccgtggagttcggcaaaatgcactacatcctgagcaccgagaatggagtggtcgccgccgcgtcctttggcgatatcgtgaaacagcgcggcgatgaaaatcagctcagttgacggcaggcgcggccagacgtccacacacaacggatggcgctggcgcgtttcttcactggcaaaactctccagtttcagcatcacgcggatagtatgttcatccaccgtgtaggcgtggaacagatcaaactgcatctgcccgacgatatgcgaccattgcggcatatacgcgccgagcacgctatggcgatgcattggcaatagcccgcgccgcaccgctccggggtgacgcagaatgctcaaaaacagttttcgtgcttccggaatattacacagcggttgttgcagatggcgacgggcatggcgtaactggcgcagcgtggtggagtaaatgccggtgatcgcactgttgtgcaccatggtgtagaacatacgcaagatggcttccggctggcgcataaatagtgtttcatcacgcaggtcgattagcgtaccgcgtagctgaaactcatcgtcgattggacgtggtttttcgtcggcgggaagggcgaggatggcttcatcgaacagttgcagcagcatctggttgagttcactgacgcggcgtgtaacgcggaagtaatccttcatcatccgctcgaccggttcgttaccttcaccactgtaattcagacgctgggcgacgctaagctggcgatcgaataacaggcgattatcgtaacggctgacgaccagatgcagggcaaagcgaatacgccacaatatatgcagacattcgtttaattccgcccgctccgctgaggttaagaagccaaacccgaccatttcatccagcgatgttgcgccaaaatgacggcgggccacccattgcagagtgtggatatcgcgcaagccgccagggctgcttttgatgtctggttcaaggttgtagctggtgccatggtaacgctgatggcgctggttctgttcttcaactttcgccgcgtagaacttgtcggaaggccagaatccttcgctgaaaatatgtttttgcagttcgaggaacagcgcaacatcgccaattaataagcgggattcgattaaattggtggcgacggttaaatccgataacccttccagcatgcactcttcaagcgtgcgcacgctatgaccgacttccagctttacatcccagagcagcgttaacagctcgcccactttttgcgcctgatcgtccgggagctttttacggcttaaaatcagtaaatcgacgtctgaaagtggatgcagctcgccacgaccgtagccaccgacggcgaccaatgccaggtcggcaatctggctgaatcccgcttcaatccataatcgttgcaggagctggtcgataaactcggtgcgcgcctcaatcaactgttctgcagagatcccattgtcaaaggcatcacccagccaacgctggaaagtatcgatatgggcttttatcccaccgacggttaattcatcacggggccagacgcatggattttgcggttgaccgggcagggtggggagagcggtgtttgcgtactgttctggaagggtattcattgtgcgccacccataagattaaattatcgcattaaaaaagccggcattcgccggcttcatcttattcgtcgtgcgagattatcgccgggatggtgtcatccttgcgtagcgtcagaatttcgcagccgttatcagtcaccacaatagtatgctcatattgtgcagacaagctgcgatctttggtttttaccgtccagccatctttcatggtgcggatctcttttttacccgcgttgaccattggctcgatggtgaacgtcatcccaggtttcagtacgacgttggtttcacgggagtcatagtgcagcacctgcggttcttcatggaagccgcgaccaataccgtgtccgcaatattcacgaacgacggagaagccttctgcttcgacaaatttctgaatcgccgcaccgatttcgcgcagattaatgcctggttttaccatgcgtagcgccaggtacaggctttcttgcgtgatgcggcacagacgttcgcccatgatggtcggcttaccgacgataaacattttcgaggtatcgccgtggaaaccatctttgattacggtgacatcaatgttaacgatatcgccatctttcagcagcttagcatcgtccgggataccgtggcacaccacttcattaatagagatgcaaacggatttcggatagccgtgatagccgaggcaggcagaaaccgcgtgttgttcattaacaatgtaatcattacagatgcgatccagctcgccggtgctgacgcccggtttaacatacggttcgatcatctccagcacttcggcagccagtcggccagcgacgcgcattttttcgatatcttctggggtcttgattgagatagccattaattctgtccatcagcgtcggtgataccgacaatatatatgtaagtgccgtcaatggtatcacacccgggcaaattgagaatcattctgaatttcgccaaacgtgccactgaaggttttctataatagaaaattcgacgtctgatgctgtacacagcgccaacaattattggtgtccacgacgtatttgtggtataaagcgcgccggacttccgatccatttcgtatacacagactggacggaagcgacaatctcactttgtgtaacaacacacacgtatcggcacatattccggggtgccctttggggtcggtaatatgggatacgtggaggcataaccccaacttttatatagaggttttaatcatggcaactgtttccatgcgcgacatgctcaaggctggtgttcacttcggtcaccagacccgttactggaacccgaaaatgaagccgttcatcttcggtgcgcgtaacaaagttcacatcatcaaccttgagaaaactgtaccgatgttcaacgaagctctggctgaactgaacaagattgcttctcgcaaaggtaaaatccttttcgttggtactaaacgcgctgcaagcgaagcggtgaaagacgctgctctgagctgcgaccagttcttcgtgaaccatcgctggctgggcggtatgctgactaactggaaaaccgttcgtcagtccatcaaacgtctgaaagacctggaaactcagtctcaggacggtactttcgacaagctgaccaagaaagaagcgctgatgcgcactcgtgagctggagaaactggaaaacagcctgggcggtatcaaagacatgggcggtctgccggacgctctgtttgtaatcgatgctgaccacgaacacattgctatcaaagaagcaaacaacctgggtattccggtatttgctatcgttgataccaactctgatccggacggtgttgacttcgttatcccgggtaacgacgacgcaatccgtgctgtgaccctgtacctgggcgctgttgctgcaaccgtacgtgaaggccgttctcaggatctggcttcccaggcggaagaaagcttcgtagaagctgagtaataaggcttgataactcccccaaaatagttcgagttgcagaaaggcggcaagctcgagaattcccgggagcttacatcagtaagtgaccgggatgagcgagcgaagataacgcatctgcggcgcgaaatatgaagggggagagcccttatagaccaggtagtacacgtttggttagggggcctgcatatggccccctttttcacttttatatctgtgcggtttaatgccgggcagatcacatctccgaggattttagaatggctgaaattaccgcatccctggtaaaagagctgcgtgagcgtactggcgcaggcatgatggattgcaaaaaagcactgactgaagctaacggcgacatcgagctggcaatcgaaaacatgcgtaagtccggtgctattaaagcagcgaaaaaagcaggcaacgttgctgctgacggcgtgatcaaaaccaaaatcgacggcaactacggcatcattctggaagttaactgccagactgacttcgttgcaaaagacgctggtttccaggcgttcgcagacaaagttctggacgcagctgttgctggcaaaatcactgacgttgaagttctgaaagcacagttcgaagaagaacgtgttgcgctggtagcgaaaattggtgaaaacatcaacattcgccgcgttgctgcgctggaaggcgacgttctgggttcttatcagcacggtgcgcgtatcggcgttctggttgctgctaaaggcgctgacgaagagctggttaaacacatcgctatgcacgttgctgcaagcaagccagaattcatcaaaccggaagacgtatccgctgaagtggtagaaaaagaataccaggtacagctggatatcgcgatgcagtctggtaagccgaaagaaatcgcagagaaaatggttgaaggccgcatgaagaaattcaccggcgaagtttctctgaccggtcagccgttcgttatggaaccaagcaaaactgttggtcagctgctgaaagagcataacgctgaagtgactggcttcatccgcttcgaagtgggtgaaggcatcgagaaagttgagactgactttgcagcagaagttgctgcgatgtccaagcagtcttaattatcaaaaaggagccgcctgagggcggcttctttttgtgcccatcttgtaaattcagctaacccttgtggggctgcgctgaaaagcgacgtacaatgtcgctagtattaattcatttcaatcgttgacagtctcaggaaagaaacatggctaccaatgcaaaacccgtctataaacgcattctgcttaagttgagtggcgaagctctgcagggcactgaaggcttcggtattgatgcaagcatactggatcgtatggctcaggaaatcaaagaactggttgaactgggtattcaggttggtgtggtgattggtgggggtaacctgttccgtggcgctggtctggcgaaagcgggtatgaaccgcgttgtgggcgaccacatggggatgctggcgaccgtaatgaacggcctggcaatgcgtgatgcactgcaccgcgcctatgtgaacgctcgtctgatgtccgctattccattgaatggcgtgtgcgacagctacagctgggcagaagctatcagcctgttgcgcaacaaccgtgtggtgatcctctccgccggtacaggtaacccgttctttaccaccgactcagcagcttgcctgcgtggtatcgaaattgaagccgatgtggtgctgaaagcaaccaaagttgacggcgtgtttaccgctgatccggcgaaagatccaaccgcaaccatgtacgagcaactgacttacagcgaagtgctggaaaaagagctgaaagtcatggacctggcggccttcacgctggctcgtgaccataaattaccgattcgtgttttcaatatgaacaaaccgggtgcgctgcgccgtgtggtaatgggtgaaaaagaagggactttaatcacggaataattcccgtgatggataaataagggtaagattccgcgtaagtatcgcgggggcgtaagtctggttataaggcgttattgttgcaggcagtttggtcacggccagcgcgcagcaaccggagcgtacaaaagtacgtgaggatggcgagcactgcccggggccaaaatggcaaataaaatagcctaataatccagacgattacccgtaatatgtttaatcagggctatacttagcacacttccactgtgtgtgactgtctggtctgactgagacaagttttcaaggattcgtaacgtgattagcgatatcagaaaagatgctgaagtacgcatggacaaatgcgtagaagcgttcaaaacccaaatcagcaaaatacgcacgggtcgtgcttctcccagcctgctggatggcattgtcgtggaatattacggcacgccgacgccgctgcgtcagctggcaagcgtaacggtagaagattcccgtacactgaaaatcaacgtgtttgatcgttcaatgtctccggccgttgaaaaagcgattatggcgtccgatcttggcctgaacccgaactctgcgggtagcgacatccgtgttccgctgccgccgctgacggaagaacgtcgtaaagatctgaccaaaatcgttcgtggtgaagcagaacaagcgcgtgttgcagtacgtaacgtgcgtcgtgacgcgaacgacaaagtgaaagcactgttgaaagataaagagatcagcgaagacgacgatcgccgttctcaggacgatgtacagaaactgactgatgctgcaatcaagaaaattgaagcggcgctggcagacaaagaagcagaactgatgcagttctgatttcttgaacgacaaaaacgccgctcagtagatccttgcggatcggctggcggcgttttgctttttattctgtctcaactctggatgtttcatgaagcaactcaccattctgggctcgaccggctcgattggttgcagcacgctggacgtggtgcgccataatcccgaacacttccgcgtagttgcgctggtggcaggcaaaaatgtcactcgcatggtagaacagtgcctggaattctctccccgctatgccgtaatggacgatgaagcgagtgcgaaacttcttaaaacgatgctacagcaacagggtagccgcaccgaagtcttaagtgggcaacaagccgcttgcgatatggcagcgcttgaggatgttgatcaggtgatggcagccattgttggcgctgctgggctgttacctacgcttgctgcgatccgcgcgggtaaaaccattttgctggccaataaagaatcactggttacctgcggacgtctgtttatggacgccgtaaagcagagcaaagcgcaattgttaccggtcgatagcgaacataacgccatttttcagagtttaccgcaacctatccagcataatctgggatacgctgaccttgagcaaaatggcgtggtgtccattttacttaccgggtctggtggccctttccgtgagacgccattgcgcgatttggcaacaatgacgccggatcaagcctgccgtcatccgaactggtcgatggggcgtaaaatttctgtcgattcggctaccatgatgaacaaaggtctggaatacattgaagcgcgttggctgtttaacgccagcgccagccagatggaagtgctgattcacccgcagtcagtgattcactcaatggtgcgctatcaggacggcagtgttctggcgcagctgggggaaccggatatgcgtacgccaattgcccacaccatggcatggccgaatcgcgtgaactctggcgtgaagccgctcgatttttgcaaactaagtgcgttgacatttgccgcaccggattatgatcgttatccatgcctgaaactggcgatggaggcgttcgaacaaggccaggcagcgacgacagcattgaatgccgcaaacgaaatcaccgttgctgcttttcttgcgcaacaaatccgctttacggatatcgctgcgttgaatttatccgtactggaaaaaatggatatgcgcgaaccacaatgtgtggacgatgtgttatctgttgatgcgaacgcgcgtgaagtcgccagaaaagaggtgatgcgtctcgcaagctgaggataatccggctacagagagtcgcgctatttgttagcgtagggcttcagtgatatagtctgcgccatctgatcgtaagtagttggctttataaggtcagatatgccgtggttttacacggcttttttttgtataggcttcagtattcctgagtaccgtaaaccctgtcagggaataaaaaacgcgtgatgttgtctgctactcaaccacttagcgaaaaattgccagcgcatggctgccgtcatgttgcgatcattatggacggcaatggccgctgggcaaaaaagcaagggaagattcgtgcctttgggcataaagccggggcaaaatccgtccgccgggctgtctcttttgcggccaacaacggtattgaggcgttaacgctgtatgcctttagtagtgaaaactggaaccgaccagcgcaggaagtcagtgcgttaatggaactgtttgtgtgggcgctcgatagcgaagtaaaaagtctgcaccgacataacgtgcgtctgcgtattattggcgataccagtcgctttaactcgcgtttgcaagaacgtattcgtaaatctgaagcgctaacagccgggaataccggtctgacgctgaatattgcggcgaactacggtggacgttgggatatagtccagggagtcaggcaactggctgaaaaggtgcagcaaggaaacctgcaaccagatcagatagatgaagagatgctaaaccagcatgtctgtatgcatgaactggcccctgtagatttagtaattaggactgggggggagcatcgcattagtaactttttgctttggcaaattgcctatgccgaactttactttacagatgttctctggcccgatttcgatgaacaagactttgaaggggcgttaaatgcctttgctaatcgagagcgtcgtttcggcggcaccgagcccggtgatgaaacagcctgatgggggtcgcttttgctgaagtatcgcctgatatctgcttttgtgttaatacccgtcgtcatcgcggcgttgtttctgttgccgccggtggggttcgccattgtaacgctggtggtctgcatgctggcagcgtgggaatggggacagcttagcggttttaccactcgttcgcagcgagtatggttggcggtgttatgcgggttattgttggcgctgatgctttttctgttgccggaatatcaccgaaatattcatcaaccgctggttgaaatctcactttgggcttcgctgggttggtggattgtcgcgctattgctggtgctgttttacccaggttccgcagcaatctggcgtaactctaaaacattgcgccttatttttggcgtgctaaccattgttcccttcttctggggcatgctggcgttacgggcctggcactatgacgagaatcattacagtggcgcaatatggctgctctatgtcatgatcctggtatggggcgctgactccggcgcatatatgtttggcaaattgtttggtaaacataagctggcaccgaaggtttctccgggtaaaacctggcaaggctttatcggtggactcgctactgcagcggtaatctcatggggttatggcatgtgggcgaatctcgacgtcgctcccgtcaccttactcatttgctctattgtcgcagcgttagcctcagtgctcggcgatctgaccgagagtatgtttaagcgtgaagcaggaattaaggacagcggtcatttaattccaggacacggtggtattttagatcgtattgatagcctgacggctgcggtaccggtctttgcttgcttgttgttactggtattcaggacgctttaacggaaggtaatatgctgagttttctctgggatttggcttcgttcatcgttgcactgggtgtacttatcaccgtgcatgaatttggtcatttctgggttgcccggcgttgtggtgttcgcgttgagcgtttctcaatagggtttggtaaggcgctctggcggcgaactgataagctcggcaccgaatatgttatcgccctgatcccgttgggcggttatgtcaaaatgctggatgagcgcgcagaaccggtcgttccggaactccgccaccatgccttcaataataaatctgtcggccaacgagcggcgattattgccgcaggtccggttgcaaacttcatttttgctatctttgcctactggctggtttttattattggtgtgcctggcgtacgtccggtggttggcgaaatagcagccaattcgatagctgcggaagcacaaattgcaccaggtacggaactaaaagccgtagatggtatcgaaacgcctgattgggatgccgtgcgtttgcagttggtcgataaaattggcgatgaaagcaccaccattacagtagcgccatttggcagcgaccaacggcgggatgtaaagctcgatttacgtcactgggcgtttgagcctgataaagaagatccggtatcttcgctggggattcgtcctcgtgggccgcaaattgaacctgtactggaaaatgtgcagccaaactcggcggcaagcaaggcaggtttgcaagcaggcgacaggatcgttaaagtcgatggtcagcccttaacgcagtgggtgacctttgtgatgcttgtccgggataacccgggtaaatccttagcgttagaaatcgaaaggcaggggagtcccttgtctttgacattaatcccggagagtaaaccgggtaatggtaaagcgattggttttgtcggtattgagccgaaagtcattcctttgccagatgagtataaagttgtacgccagtatgggccgttcaacgccatcgtcgaagccacggacaaaacgtggcagctgatgaagctgacggtcagtatgctgggaaaattgatcaccggtgatgtgaaactgaacaacctcagtgggccgatctctatcgccaagggggctgggatgacagcggaactcggggttgtttattacctgccgtttcttgcgcttattagcgtgaacttagggataattaacctgtttccgttgcccgtacttgacggggggcatctgctgttccttgcgatcgaaaagatcaagggcggaccggtatccgagcgggttcaagacttttgttatcgcattggctcgattctgctggtgctgttaatggggcttgcacttttcaatgatttctctcggttatgagagttagttaggaagaacgcataataacgatggcgatgaaaaagttgctcatagcgtcgctgctgtttagcagcgccaccgtatacggtgctgaagggttcgtagtgaaagatattcatttcgaaggccttcagcgtgtcgccgttggtgcggccctcctcagtatgccggtgcgcacaggcgacacggttaatgatgaagatatcagtaataccattcgcgctctgtttgctaccggcaactttgaggatgttcgcgtccttcgtgatggtgatacccttctggttcaggtaaaagaacgtccgaccattgccagcattactttctccggtaacaaatcggtgaaagatgacatgctgaagcaaaacctcgaggcttctggtgtgcgtgtgggcgaatccctcgatcgcaccaccattgccgatatcgagaaaggtctggaagacttctactacagcgtcggtaaatatagcgccagcgtaaaagctgtcgtgaccccgctgccgcgcaaccgtgttgacctaaaactggtgttccaggaaggtgtgtcagctgaaatccagcaaattaacattgttggtaaccatgctttcaccaccgacgaactgatctctcatttccaactgcgtgacgaagtgccgtggtggaacgtggtaggcgatcgtaaataccagaaacagaaactggcgggcgaccttgaaaccctgcgcagctactatctggatcgcggttatgcccgtttcaacatcgactctacccaggtcagtctgacgccagataaaaaaggtatttacgtcacggtgaacatcaccgaaggcgatcagtacaagctttctggcgttgaagtgagcggcaaccttgccgggcactccgctgaaattgagcagctgactaagatcgagccgggtgagctgtataacggcaccaaagtgaccaagatggaagatgacatcaaaaagcttctcggtcgctatggttatgcctatccgcgcgtacagtcgatgcccgaaattaacgatgccgacaaaaccgttaaattacgtgtgaacgttgatgcgggtaaccgtttctacgtgcgtaagatccgttttgaaggtaacgatacctcgaaagatgccgtcctgcgtcgcgaaatgcgtcagatggaaggtgcatggctggggagcgatctggtcgatcagggtaaggagcgtctgaatcgtctgggcttctttgaaactgtcgataccgatacccaacgtgttccgggtagcccggaccaggttgatgtcgtctacaaggtaaaagagcgcaacaccggtagcttcaactttggtattggttacggtactgaaagtggcgtgagcttccaggctggtgtgcagcaggataactggttaggtacaggttatgctgttggtatcaacgggaccaaaaacgattaccagacctatgctgaactgtcggtaaccaacccgtacttcaccgtagatggcgtaagcctcggtggtcgtctcttctataatgacttccaggcagatgacgccgacctgtccgactataccaacaagagttatggtacagacgtgacgttgggcttcccgattaacgaatataactcgctgcgtgcaggtctgggttatgtacataactccctgtccaacatgcagcctcaggttgcgatgtggcgttatctgtactctatgggtgaacatccgagcacctctgatcaggataacagcttcaaaacggacgacttcacgttcaactatggttggacctataacaagcttgaccgtggttacttcccgacagatggttcacgtgtcaacctgaccggtaaagtgaccattcctggatcggataacgaatactacaaagtgacgttagacacggcgacttatgtgccgatcgatgacgatcacaaatgggttgttctggggcgtacccgctggggttatggtgatggtttaggcggcaaagagatgccgttctacgagaacttctatgccggtggttccagcaccgtgcgtggcttccagtccaataccattggtccgaaagcagtttacttcccgcatcaggccagtaattatgatccggactatgattacgaatgtgcgactcaggacggcgcgaaagacctgtgtaaatcggatgatgctgtaggcggtaacgccatggcggttgccagcctcgagttcatcaccccgacgccgtttattagcgataagtatgctaactcggttcgtacttccttcttctgggatatgggtaccgtttgggatacaaactgggattccagccaatattctggatatccggactatagtgatccaagcaatatccgtatgtctgcgggtatcgcattacaatggatgtccccattggggccgttggtgttctcctacgcccagccgttcaaaaagtacgatggagacaaggcagaacagttccagtttaacatcggtaaaacctggtaagtgttctccacaaaggaatgtagtggtagtgtagcgatgactttaggcgatcaatataagatcgccgggccacgcaaagaactgcaccctccggtgcaaatgggatggtaaggagtttattgtgaaaaagtggttattagctgcaggtctcggtttagcactggcaacttctgctcaggcggctgacaaaattgcaatcgtcaacatgggcagcctgttccagcaggtagcgcagaaaaccggtgtttctaacacgctggaaaatgagttcaaaggccgtgccagcgaactgcagcgtatggaaaccgatctgcaggctaaaatgaaaaagctgcagtccatgaaagcgggcagcgatcgcactaagctggaaaaagacgtgatggctcagcgccagacttttgctcagaaagcgcaggcttttgagcaggatcgcgcacgtcgttccaacgaagaacgcggcaaactggttactcgtatccagactgctgtgaaatccgttgccaacagccaggatatcgatctggttgttgatgcaaacgccgttgcttacaacagcagcgatgtaaaagacatcactgccgacgtactgaaacaggttaaataagtaatgccttcaattcgactggctgatttagcgcagcagttggatgcagaactacacggtgatggcgatatcgtcatcaccggcgttgcgtccatgcaatctgcacaaacaggtcacattacgttcatggttaacccaaaataccgtgagcatttaggcttgtgccaggcgtccgcggttgtcatgacccaggacgatcttcctttcgcgaaaagtgccgcactggtagtgaagaatccctacctgacttacgcgcgcatggcgcaaattttagataccacgccgcagcccgcgcagaacattgcacccagtgcggtgatcgacgcgacggcgaagctgggtaacaacgtatcgattggcgctaacgcggtgattgagtccggcgttgaactgggcgataacgtgattatcggtgccggttgcttcgtaggtaaaaacagcaaaatcggtgcaggttcgcgtctctgggcgaacgtaaccatttaccatgagatccagatcggtcagaattgcctgatccagtccggaacagtggtaggcgcagacggctttggttatgccaacgatcgtggtaactgggtgaagatcccacagattggtcgcgtaattattggcgatcgcgtggagatcggtgcctgcacaaccatcgatcgcggcgcgctggatgacactattattggcaatggcgtgatcattgataaccagtgccagattgcacataacgtcgtgattggcgacaatacggcggttgccggtggcgtcattatggcgggcagcctgaaaattggtcgttactgcatgatcggcggagccagcgtaatcaacgggcatatggaaatatgcgacaaagtgacggttacgggcatgggtatggtgatgcgtcccatcactgaaccaggcgtctattcctcaggcattccgctgcaacccaacaaagtctggcgcaaaaccgctgcactggtgatgaacattgatgacatgagcaagcgtctgaaatcgcttgagcgcaaggttaatcaacaagactaacgttccatcttttgttcgccaaactttacggcctgtctcattcttacgattgcggcaggccgtgttattattgtcgtttcttatattttgacaggaagagtatcttgactactaacactcatactctgcagattgaagagattttagaacttctgccgcaccgtttcccgttcttactggtggatcgcgtgctggattttgaagaaggtcgttttctgcgcgcagtaaaaaatgtctctgtcaatgagccattcttccagggccatttccctggaaaaccgattttcccgggtgtgctgattctggaagcaatggcacaggcaacaggtattctggcgtttaaaagcgtaggaaaactggaaccgggtgagctgtactacttcgctggtattgacgaagcgcgcttcaagcgcccggtcgtgcctggcgatcaaatgatcatggaagtcactttcgaaaaaacgcgccgcggcctgacccgttttaaaggggttgctctggtcgatggtaaagtagtttgcgaagcaacgatgatgtgtgctcgtagccgggaggcctgatacgtgattgataaatccgcctttgtgcatccaaccgccattgtggaagagggcgcgtcaattggcgcgaacgcacacattggtcctttttgtatcgttggaccccatgtcgaaattggtgagggtaccgtactgaaatctcacgttgtcgtgaatggtcatactaaaattggccgcgataatgagatttatcagttcgcctccatcggcgaagttaaccaggatctgaaatatgctggcgaaccgacccgtgtggaaatcggcgatcgtaaccgcattcgcgaaagcgtcaccattcatcgtggcacagtccagggcggtggattgacgaaggtgggcagcgacaacttactgatgatcaacgcgcacattgcgcacgattgtacggtaggtaaccgctgtattctcgccaacaacgcaacgctggcgggtcacgtatcggttgacgacttcgcgatcatcggcggcatgaccgcagtccatcagttctgcatcattggtgcgcacgtgatggttggcggctgctccggtgtggcgcaggacgtccctccttatgtcattgcgcagggtaaccacgcaacgccgttcggtgtcaatatcgaagggctgaagcgccgcggattcagccgtgaggcgattaccgctatccgcaatgcgtataagctgatttatcgtagcggtaaaacgctcgatgaagtgaaaccggaaattgctgaactggcggaaacatatccggaagtgaaagcctttaccgatttctttgcacgctcaacgcgcggtctgattcgttaatgactgaacagcgtccattaacgattgccctggtcgccggagaaacctccggcgatatcctgggggccggtttaatccgcgctctgaaagaacatgtgcccaacgcccgctttgttggtgttgccgggccacgaatgcaggctgaaggctgcgaagcctggtacgaaatggaagaactggcggtgatgggcattgttgaagtgctcggtcgtctgcgtcgcttactgcatattcgtgccgatctgacaaagcgttttggcgaactgaagccagatgtttttgttggtattgatgcgcctgacttcaatattactcttgaaggtaacctcaaaaagcagggtatcaaaaccattcattacgtcagtccgtcagtctgggcgtggcgacagaaacgtgttttcaaaataggcagagccaccgatctggtgctcgcatttctgcctttcgaaaaagcgttttatgacaaatacaacgtaccgtgccgctttatcggtcataccatggctgatgccatgccattagatccagataaaaatgccgcccgtgatgtgctggggatccctcacgatgcccactgcctggcgttgctaccggggagccgtggtgcagaagttgaaatgcttagtgccgatttcctgaaaacggcccagcttttgcgccagacatatccggatctcgaaatcgtggtgccactggtgaatgccaaacgccgcgagcagtttgaacgcatcaaagctgaagtcgcgccagacctttcagttcatttgctggatgggatgggccgtgaggcgatggtcgccagcgatgcggcgctactggcgtcgggtacggcagccctggagtgtatgctggcgaaatgcccgatggtggtgggatatcgcatgaagccttttaccttctggttggcgaagcggctggtgaaaactgattatgtctcgctgccaaatctgctggcgggcagagagttagtcaaagaattattgcaggaagagtgtgagccgcaaaaactggctgcggcgctgttaccgctgttggcgaacgggaaaaccagccacgcgatgcacgataccttccgtgaactgcatcagcagatccgctgcaatgccgatgagcaggcggcacaagccgttctggagttagcacaatgatcgaatttgtttatccgcacacgcagctggttgcgggtgtggatgaagtcggacgcgggccgttagttggcgcggtcgtcaccgctgcggtgatccttgacccggcgcgcccgattgccgggctgaatgattccaaaaagctgagcgaaaaacgccgtctggcgctctatgaagagatcaaagagaaagcgttgagctggagtctgggccgcgcggaaccccacgaaatcgacgagctgaacattcttcatgcgaccatgctggcgatgcagcgtgccgtcgctgggctgcatattgcgccggaatatgtgttgattgatggtaaccgctgcccgaaattaccgatgcctgcgatggctgtggtgaaaggcgatagccgcgtaccggaaatcagtgccgcgtctatcctggcgaaagtgacgcgtgacgccgaaatggcggcgctggatattgttttcccgcaatatggttttgcccaacacaaagggtacccaaccgcttttcatctggaaaaactggctgaacacggcgcgaccgaacaccatcggcgcagctttgggcctgtcaaacgcgcactgggacttgcgtcctgattcttgtgtcgagattaagtaaaccggaatctgaagatgtctgaaccacgtttcgtacacctgcgggtgcacagcgactactcgatgatcgatggcctggccaaaaccgcaccgttggtaaaaaaggcggcggcgttgggtatgccagcactggcgatcaccgatttcaccaacctttgtggtctggtgaagttctacggagcgggacatggcgcagggattaagcctatcgtcggggcagattttaacgtccagtgcgacctgctgggtgatgagttaacccacctgacggtactggcggcgaacaataccggctatcagaatctgacgttgctgatctcaaaagcgtatcagcgcgggtacggtgccgccgggccgatcatcgatcgcgactggcttatcgaattaaacgaagggttgatccttctttccggcggacgcatgggcgacgtcggacgcagtcttttgcgtggtaacagcgcgctggtagatgagtgtgtcgcgttttatgaagaacacttcccggatcgctattttctcgagctgatccgcaccggcaggccggatgaagaaagctatctgcacgcggcggtggaactggcggaagcgcgcggtttgcccgtcgtggcgaccaacgacgtgcgctttatcgacagcagcgactttgacgcacacgaaatccgcgtcgcgatccacgacggctttaccctcgacgatcctaaacgcccgcgtaactattcgccgcagcaatatatgcgtagcgaagaggagatgtgtgagctgtttgccgacatccccgaagcccttgccaacaccgttgagatcgccaaacgctgtaacgtaaccgtgcgtcttggtgaatacttcctgccgcagttcccgaccggggacatgagcaccgaagattatctggtcaagcgtgcaaaagagggcctggaagagcgtctggcctttttattccctgatgaggaagaacgtcttaagcgccgcccggaatatgacgaacgtctggagactgaacttcaggttatcaaccagatgggcttcccgggctacttcctcatcgttatggaatttatccagtggtcgaaagataacggcgtaccggtagggccaggccgtggctccggtgcgggttcactggtggcctacgcgctgaaaatcaccgacctcgatccgctggaatttgacctgctgttcgaacgtttccttaacccggaacgtgtctccatgcctgacttcgacgttgacttctgtatggagaaacgcgatcaggttatcgagcacgtagcggacatgtacggtcgtgatgcggtatcgcagatcatcaccttcggtacaatggcggcgaaagcggtgatccgcgacgtaggccgcgtgctggggcatccgtacggctttgtcgatcgtatctcgaaactgatcccgcccgatccggggatgacgctggcgaaagcgtttgaagccgagccgcagctgccggaaatctacgaagcggatgaagaagttaaggcgctgatcgacatggcgcgcaaactggaaggggtcacccgtaacgccggtaagcacgccggtggggtggttatcgcgccgaccaaaattaccgattttgcgccgctttactgcgatgaagagggcaaacatccggtcacccagtttgataaaagcgacgttgaatacgccggactggtgaagttcgacttccttggtttgcgtacgctcaccatcatcaactgggcgctggagatgatcaacaagcggcgggcgaagaatggcgagccgccgctggatatcgctgcgatcccgctggatgataagaaaagcttcgacatgctgcaacgctcggaaaccacggcggtattccagcttgaatcgcgcggcatgaaggacctgatcaagcgtctacaacctgactgcttcgaagatatgatcgccctagtggcactgttccgccccggtccgttgcaatcagggatggtggataactttatcgaccgtaaacatggtcgtgaagagatctcctatccggacgtacagtggcagcatgaaagcctgaaaccggtactggagccaacctacggcattatcctgtatcaggaacaggtcatgcagattgcgcaggtgctttctggttataccctcggtggcgcggatatgctgcgtcgtgcgatgggtaagaaaaagccggaagagatggctaagcaacgttctgtatttgctgaaggtgcagaaaagaacggaatcaacgctgaactggcgatgaaaatcttcgacctggtggagaaattcgctggttacggatttaacaaatcgcactctgcggcctatgctttggtgtcatatcaaacgttatggctgaaagcgcactatcctgcggagtttatggcggcggtaatgaccgccgatatggacaacaccgagaaggtggtgggtctggtggatgagtgctggcggatggggctgaaaatcctgccaccagatataaactccggtctttaccatttccacgtcaacgacgacggcgaaatcgtgtatggtattggcgcgatcaaaggggtcggtgaaggtccgattgaggccatcatcgaagcccgtaataaaggcggctacttccgcgaactgtttgatctctgcgcccgtaccgacaccaaaaagttgaaccgtcgcgtgctggaaaaactgatcatgtccggggcgtttgaccgtcttgggccacatcgcgcagcgctgatgaactcgctgggcgatgcgttaaaagcggcagatcaacacgcgaaagcggaagctatcggtcaggccgatatgttcggcgtgctggccgaagagccggaacaaattgaacaatcctacgccagctgccaaccgtggccggagcaggtggtattagatggggaacgtgaaacgttaggcctgtacctgaccggacaccctatcaaccagtatttaaaagagattgagcgttatgtcggaggcgtaaggctgaaagacatgcacccgacagaacgtggtaaagtcatcacggctgcggggctcgttgttgccgcgcgggttatggtcaccaagcgcggcaatcgtatcggtatctgcacgctggatgaccgttccgggcggctggaagtgatgttgtttactgacgccctggataaataccagcaattgctggaaaaagaccgcatacttatcgtcagcggacaggtcagctttgatgacttcagcggtgggcttaaaatgaccgctcgcgaagtgatggatattgacgaagcccgggaaaaatatgctcgcgggcttgctatctcgctgacggacaggcaaattgatgaccagcttttaaaccgactccgtcagtctctggaaccccaccgctctgggacaattccagtacatctctactatcagagggcggatgcacgcgcgcggttgcgttttggcgcgacgtggcgtgtctctccgagcgatcgtttattaaacgatctccgtggcctcattggttcggagcaggtggaactggagtttgactaatacaggaatactatgagtctgaatttccttgattttgaacagccgattgcagagctggaagcgaaaatcgattctctgactgcggttagccgtcaggatgagaaactggatattaacatcgatgaagaagtgcatcgtctgcgtgaaaaaagcgtagaactgacacgtaaaatcttcgccgatctcggtgcatggcagattgcgcaactggcacgccatccacagcgtccttataccctggattacgttcgcctggcatttgatgaatttgacgaactggctggcgaccgcgcgtatgcagacgataaagctatcgtcggtggtatcgcccgtctcgatggtcgtccggtgatgatcattggtcatcaaaaaggtcgtgaaaccaaagaaaaaattcgccgtaactttggtatgccagcgccagaaggttaccgcaaagcactgcgtctgatgcaaatggctgaacgctttaagatgcctatcatcacctttatcgacaccccgggggcttatcctggcgtgggcgcagaagagcgtggtcagtctgaagccattgcacgcaacctgcgtgaaatgtctcgcctcggcgtaccggtagtttgtacggttatcggtgaaggtggttctggcggtgcgctggcgattggcgtgggcgataaagtgaatatgctgcaatacagcacctattccgttatctcgccggaaggttgtgcgtccattctgtggaagagcgccgacaaagcgccgctggcggctgaagcgatgggtatcattgctccgcgtctgaaagaactgaaactgatcgactccatcatcccggaaccactgggtggtgctcaccgtaacccggaagcgatggcggcatcgttgaaagcgcaactgctggcggatctggccgatctcgacgtgttaagcactgaagatttaaaaaatcgtcgttatcagcgcctgatgagctacggttacgcgtaattcgcaaaagttctgaaaaagggtcacttcggtggcccttttttatcgccacggtttgagcaggctatgattaaggaaggattttccaggaggaacacatgaacatcattgccattatgggaccgcatggcgtcttttataaagatgagcccatcaaagaactggagtcggcgctggtggcgcaaggctttcagattatctggccacaaaacagcgttgatttgctgaaatttatcgagcataaccctcgaatttgcggcgtgatttttgactgggatgagtacagtctcgatttatgtagcgatatcaatcagcttaatgaatatctcccgctttatgccttcatcaacacccactcgacgatggatgtcagcgtgcaggatatgcggatggcgctctggttttttgaatatgcgctggggcaggcggaagatatcgccattcgtatgcgtcagtacaccgacgaatatcttgataacattacaccgccgttcacgaaagccttgtttacctacgtcaaagagcggaagtacaccttttgtacgccggggcatatgggcggcaccgcatatcaaaaaagcccggttggctgtctgttttatgattttttcggcgggaatactcttaaggctgatgtctctatttcggtcaccgagcttggttcgttgctcgaccacaccgggccacacctggaagcggaagagtacatcgcgcggacttttggcgcggaacagagttatatcgttaccaacggaacatcgacgtcgaacaaaattgtgggtatgtacgccgcgccatccggcagtacgctgttgatcgaccgcaattgtcataaatcgctggcgcatctgttgatgatgaacgatgtagtgccagtctggctgaaaccgacgcgtaatgcgttggggattcttggtgggatcccgcgccgtgaatttactcgcgacagcatcgaagagaaagtcgctgctaccacgcaagcacaatggccggttcatgcggtgatcaccaactccacctatgatggcttgctctacaacaccgactggatcaaacagacgctggatgtcccgtcgattcacttcgattctgcctgggtgccgtacacccattttcatccgatctaccagggtaaaagtggtatgagcggcgagcgtgttgcgggaaaagtgatcttcgaaacgcaatcgacccacaaaatgctggcggcgttatcgcaggcttcgctgatccacattaaaggcgagtatgacgaagaggcctttaacgaagcctttatgatgcataccaccacctcgcccagttatcccattgttgcttcggttgagacggcggcggcgatgctgcgtggtaatccgggcaaacggctgattaaccgttcagtagaacgagctctgcattttcgcaaagaggtccagcggctgcgggaagagtctgacggttggtttttcgatatctggcaaccgccgcaggtggatgaagccgaatgctggcccgttgcgcctggcgaacagtggcacggctttaacgatgcggatgccgatcatatgtttctcgatccggttaaagtcactattttgacaccggggatggacgagcagggcaatatgagcgaggaggggatcccggcggcgctggtagcaaaattcctcgacgaacgtgggatcgtagtagagaaaaccggcccttataacctgctgtttctctttagtattggcatcgataaaaccaaagcaatgggattattgcgtgggttgacggaattcaaacgctcttacgatctcaacctgcggatcaaaaatatgctacccgatctctatgcagaagatcccgatttctaccgcaatatgcgtattcaggatctggcacaagggatccataagctgattcgtaaacacgatcttcccggtttgatgttgcgggcattcgatactttgccggagatgatcatgacgccacatcaggcatggcaacgacaaattaaaggcgaagtagaaaccattgcgctggaacaactggtcggtagagtatcggcaaatatgatcctgccttatccaccgggcgtaccgctgttgatgcctggagaaatgctgaccaaagagagccgcacagtactcgattttctactgatgctttgttccgtcgggcaacattaccccggttttgaaacggatattcacggcgcgaaacaggacgaagacggcgtttaccgcgtacgagtcctaaaaatggcgggataacttgccagagcggcttccgggcgagtaacgtgctgttaacaaataaaggagacgttatgctgggtttaaaacaggttcaccatattgcgattattgcgacggattatgcggtgagcaaagctttctactgcgatattcttggtttcacgctgcaaagcgaagtctatcgcgaagcgcgcgactcatggaaaggggatttggcgcttaatgggcaatatgtgattgagcttttctcatttccgttcccgccggaacgacccagccgaccggaagcttgcggtctgcgtcatctggcttttagcgttgatgacatcgatgcggcagtggcgcaccttgaaagccataacgtgaagtgtgaaaccatccgtgtcgatccatacacgcaaaaacgcttcaccttctttaacgatccggacgggctgccgttggaactgtatgagcagtaaggcttgtcatcgccgcatttgcccggtaacgtgccgggcattgctactgtaaaatcgcaccatcatgacactcacgctcaatagacaacttctcacctcacgccagattctggtggcctttagcggcgggcttgactccaccgttctgctgcatcagttggtgcagtggcggacggaaaatccgggtgtcgctctgcgcgctattcatgtgcatcacggtttaagtgccaatgccgatgcctgggttacgcattgcgaaaacgtctgccaacagtggcaggtgccgctggtggtcgaacgcgtacaacttgcgcaagaaggactgggcattgaggcccaggcgcggcaggcacgttatcaggcatttgcccgcaccttgttgcccggtgaagtgctggtcaccgcgcaacatctcgacgatcaatgtgaaacctttctgctggcgctaaaacgcggcagtggccctgccgggctttcggctatggcggaagtctcggagtttgccggaacgcggcttattcgcccgttgctcgcccgcacgcggggggaactggtgcagtgggcgcgtcagtatgatttacgctggattgaagacgaaagtaatcaggacgactcatacgatcgtaactttctgcgcctgcgcgtagtgccgttattgcagcagcgttggccgcattttgccgaagcaacggcccgcagcgccgcactttgtgctgaacaagagagcctgctggatgaactgctggcagatgatttagcacactgtcaatcgccgcaggggacgctgcagattgtgccaatgctggcgatgagtgatgcccgccgcgcggcgattatccgccgctggctggcagggcagaatgcaccgatgccttcccgcgacgcgttggtgaggatctggcaggaagtggcgctggcgcgggaagatgcctcaccctgtttacgtttgggcgcgtttgaaatccgacgctatcagtcgcaactgtggtggattaaatccgtcaccgggcaaagcgaaaacattgtgccgtggcagacgtggcttcaaccgctggaattaccggcggggctgggaagtgtacagcttaatgcgggaggcgatattcgccctccgcgtgcagacgaagcggtcagcgtgcgtttcaaagcgccaggattgctgcatattgtcgggcgtaacggcggacgtaagctaaagaaaatctggcaagagctgggcgtgccgccgtggctacgtgacaccacgccactgctgttttatggcgaaacgctgattgcggcggcaggggtatttgtgacgcaagaaggtgtggctgaaggtgagaatggcgtaagttttgtctggcagaaaacgcttagttaagtgaaagccggataagacgcatcaaacgtcgcatccggcgaaagtcaatcaggattcgcttaccaccaccgtaccgatttccgggtggctaaagctggtaattttatccagacgcagctcgcgggtttcgccagcggcctcgacgaccaggtactccacatttttgcgggagactaaatcactggcttttgcctgcaatttttcgccatctttcagctcaagtgtcagcattaaatgatgctggcaggcgagctcaagattatcgtaatcatcacaattgattggttgatacgtatcattcattgacataatcgctcaccagtaagtttgccgcagcgtatgctgctttttccctgacagcctcagaaagggcgtcgtcggcagccatttcattcagcactttcaaaacgcagcccagcgcgtccggaacgtatcctaagtctccgctggcgatttccgcgtaccgcttgcgtattaactcacaatatttttccacatgccctcctgtcagcactctgacttaaccgtggatgcaagtctaagcctacgaagataaactctgtttcgcaaggtgactataccacactcatttctgcaatatcagcgccgcaactgcacgtattccgttacaatggcctcctgattcgaaaggagttttcttatggcgcttaaagcgacaatttataaagcgacggttaatgtggccgatctcgaccgcaaccagtttctcgatgcctctctgacgctggcgcgccatccttcagaaacccaggagcgtatgatgctgcgcttgctggcgtggctgaaatatgctgatgaacgtctgcaatttacccgtggtttgtgtgccgatgatgagccggaagcgtggctgcgtaacgatcacctgggcattgatttgtggattgagctggggctgccggatgagcggcggattaagaaagcctgcacccaggccgcagaagtggcgctgtttacctataatagtcgggcggcgcaaatctggtggcagcaaaatcagagcaaatgtgtgcagtttgccaatctttccgtctggtatctggacgatgaacaactggcgaaagtaagcgcctttgccgatcgtaccatgacgctgcaggcaacgattcaggatggcgtgatctggttatcggatgataagaataatctggaagtgaacttaaccgcctggcaacaaccttcatgattgtgatttcccgacatgttgctattcccgatggtgagcttgagatcaccgccattcgtgcgcagggcgcgggcgggcagcatgttaataagacctcaacggctattcatctgcgttttgacattcgggcgtccagcctgccagagtattacaaagagcgtctgctcgccgccagccatcatttgatcagcagtgatggcgtgattgtcattaaggcacaggaataccgcagtcaggaactgaaccgcgaagcagctctggcccggctggtggctatgattaaagaattaacaacagaaaaaaaagcccgacgacccacgcggcccacccgtgcatcgaaagagcgcaggctggcatcgaaagcacaaaaatcaagcgtgaaggcgatgcgcggcaaagtgcgcagcggtcgggaataaaaagaaggaatggatggtgaaaaaagcgatagtgacagcgatggctgtaatcagcctctttactctgatgggatgtaataatcgggccgaagtcgatacgctttctccggcgcaggctgccgaactgaaaccgatgccgcaaagttggcgcggcgtgctgccgtgtgccgattgcgaaggaatcgaaacctctctgttcctcgaaaaagacggaacatgggtgatgaatgagcgttatctcggtgctcgtgaagaaccttcctccttcgcttcctacggtacatgggcgcgaaccgctgacaagctggtattaaccgacagcaaaggtgaaaagtcatattatcgggcgaaaggcgatgcgctggagatgctcgatcgtgaaggcaatccgattgaatcgcagttcaactatacgctggaagcggcacaatccagtttacctatgacgccgatgaccctgcggggcatgtatttttatatggctgatgcggcgaccttcactgattgcgcgaccggaaaacgtttcatggtagcgaataacgcagagctggagcgtagctacctggctgcgcgcggtcacagtgaaaaaccggtgttactgtcagtagaaggtcactttacgcttgagggtaatccggataccggtgcgccgactaaagtattggcacccgatacggcagggaaattttaccccaaccaggattgcagtagtttggggcagtaacccgtcttgagacagaaacaaacgcaaaacaggccagaaggatatatttcaacattttgaatttgcacgttttttgtaggccggataaggcgtttacgccgcatccggcaatggtgctcaacgcctgatgcgacgctggcgcgtcttatcatgcctacaacccccctcataccttaaggcggataaggcatttactttatcaccgggtcaaaccaacaaagcgacccgccttgatataaatcccaggcttcaggtgcccaacatactgtaactgcgtttctggcttaaacgcagagacatcaccaatacgcatatgcatcagatcggcagggctaatccagcccgattgcgccagtgtaagtggatgcccggctttggcaaaggcatccgtgacaaattccgaacaaaaccacgactttttgtctccttcgcccacactgcttaactgcgctttcgccaggccgctgacgcactgttggcgaaaatcctcggagaacggattcagtgagcacatctggcgagtcaccataaagggaataaattcgacaatgccgcgatagttataaccgctatctttgattttattggcaaacgcggtgatatctgtggcttgttgcggggtaagatccgggactcgtaagacgaaaagcttatcactatgcttcatcgcttttttaagggaaacgatctggacgccagcgcctgtcgcttctgcaacgttattatcacccagaaagattgcaacgtgactcacagaggaagtgctgaagacgcggattccaaatgaggttaccccaaggcttgaggagaacagcaaatcgccgggtttgagatcaggtgccgttatttcttttattgattgttcggtgaaagagctttgatgctggaatttgacagcccatgtttttgcctcggcatctactgctgtggctgatgggtctggctggctgatatcaacggtacaagccgaaagtaaaagaaagctggggagaaacaggcggcagtacgcctttggtttatccattttatacaatccatgtaaaaaaagggccctgaaattcaggaccctttctggcatcagcctttaatctgtttcaccagatattcgacgatgtcaccagtcttaattaactgtttctcgccgttgcgacgatatttatattcgatatcgtcgttgtcgaggttacggtcgcccagcacaatagtgtgcggaataccgatcagttccatatcagcaaacatcacgcccggacgctctttgcggtcatccagcagcacttcgataccttgtgcacgcagttcgctgtacagtttctcagcaagctcttgtacgcggaaggatttgtgcatgttcatcggcagaatcgccacctggaacggcgcgatagcgtcaggccatacgatgcctcgttcgtcgtagttctgctcaatcgccgcagctaccacacgcgttaccccgataccgtagcaacccatcgtcaggatttggttacggccatcttcaccctgtacggaggctttcagtgcttcggagtacttggtacccagctggaagatgtgaccaacttcgataccacgtttgatcagcagcctaccctggccatccgggcttggatcgccagccaccacgttacggatatctgcaacttccggggtagcgacatcgcgatcccagttgatgccgaagtagtgtttaccatcgatgttagcaccagcagcgaaatcactcatcgccgcaacggtacggtcaatcaccaccggaatcggcatgtttaccggacccagtgaacccggaccggctttaaccacggcacgaatttcttcttcggtcgcgaaagtcagcgggcttgcaacctgcggcagtttttctgctttaacttcgttcagctcgtgatcaccgcgcaccagcagcgcaacctgcgggaagctgctgccttcaaccgctttaaccagcagagtcttaaccgttttctcaatcggcagattgaactgttcaaccagttccgcgatggttttcgcgttcggcgtatcaaccagcgtcatttcctgggtagcagcagcgcgcggttctttcggcgcgatagcttctgccagttcaatgttcgctgcatagtcagaggtgtcggagaagaccacatcgtcttcaccgctctgcgccagcacctggaattcgtgagaggcgctgccgccgatagaaccggtgtcggcttgtacggcgcggaaatccagccccatgcggctgaagattttgctgtaggccgcatacattgcatcgtaggtttcctgcagggattcctgagaagtatggaaagagtaagcatctttcatcaggaattcgcgggaacgcatgacgccgaaacgcggacgcacttcgtcgcggaacttggtctggatctgatagaagttcagcggcagctgtttgtaagagctaagctcgttacgaatcaggtcagtgataacttcttcatgagttgggccgagtacgaacggacgctcgccacggtcaacaaaacgcagcagttccggaccgtactgttcccaacgaccactctcttgccacaaatcggctggctgaaccaccggcatcgacacctcgatcgcaccggcgttgttcatctcttcacgcacgatgttttcgacttttttcagaacgcgcacgccggtcggcagccaggtatataacccggaggccagcttgcggatcatcccggcgcgcagcatcagctgatggctgatcacctcggcgtcggcaggtgtctccttgagagtggagagcaggtattggctagtacgcatgttgttacggttccagttggaaggtagaacaggctcaaggcgagcctgggacaaaaaaaagtgatttagtttaccagtgcaaaagaaatgtcaaaagagaagggcgtgaatttaacgcggttccagcgcaaagacttcaaaacctgcgtcggtgacgcgccagcgaacgttaaaatcatgtagccagacggcataggttttgcccgtttcctcacctttacgataggccgggcgcgggtcctgcgccagtacttcgcggataaacagcgttaactgcggataacgcttctccagcgtcaaaagctgcttttcgacctctgcggtaaaactcaccgccatctctgcagctggcgcactttgcgcatagctggcactggcatcgggaagcgattcggcaaaggggagatacggtttgatatccactaccggcgtaccatcgaccagatccagactgccgagcttcagaatcacgctgtctttatggcaaacaacctctttcagctctaccagcgacatgccaattgggttagggcggaaagtagagcgtgttgcgaaaacccccattctggcgttaccgccgaggcgcggtggacgcacagtcggacgccagccgccttccatcgtttgatgaaagacgaaaaggatccataaatggctgaacgcttccaggccgcgaacggcgtcggcctggttgtagggagcaatgagatgcagttcgccgttggcgctttttaccagacctggctggcgcggaacggcgaacttttctttatagggcgagcgaataacgcctatttgctcgaactggaaactgctcatttcgccgtaatgttaagcgcagaaccgatacatacagcctgacgatagcagcctggcgtaccgctggtgacttcgcagctatgcagtaatacagcattggctttcattttagaggcgttgatttgcatccgcttacgtgcggttggaatgctcggcggagagtcctgattagaggcctggcaagagtcgccactgacttcaccgagatcgcggaacggtttgccgactaattcttctgcattggtataaattcggaccggcgtggcgcgcggcgctttcggttttgcaggctccgctttcggctggggtgcagtgctttgaacgggttcgacaggggatctgcttaacatggaacagccgcttagcatgagtgctactaaacagatcggtaaagcacgcatagtatttcctcaatgtatgatcaaaacgtcaatattgaatcaggagcttgtaaaaatgacaagacgggcaagcgcccgtcctgaatgatattacaaattgtggaaacagcctaaaaattaccagcctttaacagctccgccgttaaacactttgtttgctgcttcgtaaacttcgtcagactgataagcctggacgaatttcttcacgttctcggcgtctttgttatcttcacgcgtcacgatcaggtttacgtacggggactctttatcttcaacaaagataccgtctttcgccggagtcaggccaatctggctggcataggtggtattgataactgccagagcgatttgcgcgtcgtccagagaacgcggcagttgcggtgcttccagttcaacaattttcagatttttggggttctcaacaacatcaagaacggtcggcagcaggccaacgccatctttcagtttgatcaagcccactttttgcagcagcagcagtgaacgaccaaggttagttgggtcgtttggcacggcaacctgcgaaccatcctgcagttcatccagtgatttgattttcttggagtaaccagcaatcggataaacaaaagtgttgcctactgcgaccagtttgtagccacgatctttcagttgctgatcaaggtacggtttatgctggaaggcgttggcgtcgatatcgcctttgctcaatgcttcgtttggcagaacatagtcgttgaaggttaccagctcaacgtccaggccatatttgtctttcgcaactttctgcgcgacttctgcaacctgctgttcggcaccaacaatcacgccgactttaatgtggtttggatctttttcatcctgaccgcagcctaccagtgccagtgatccgatcagggctcccactgccgcaaaggttttgaatttgaacgccataccttattccttcttcaattatttatgttgtgttgaacgttacttgcgagtgacagcccggacgatgcggtcgcctgcgaactgaattaaataaaccagaatgaccagcaataccagtaccgtattcatcaccgtcgcgttatagccgatgtagccatactgatagccaatctgacctaaaccaccggcaccgactgcaccacccatcgcggaataaccgaccagggtaatcagggtgatagttgccgcattcaccagacccggcagcgcttccggtaacagcaccttacggacgatctgcatcggcgtggcacccattgcgcgggaagcttcaattaacccggttgggatctccagcagagcgttctcgaccatacgggcaataaacggtgctgcaccaacggttaacggaacaatcgctgcctgcaaaccaatcgatgtaccgacaataacgcgggtaaacggaatcatccatacaagcaagataatgaacgggatggaacggaaaatgttcacaatcgcagaaacggtacgatacagcttcgcgttagcaataatttgccccggacgcgtgacataaagcagaacgccaaccggcagaccaatcacaaagccaaaaaaaccggatacgaaggtcattgccagcgtttcccatacgccacgaaccagcagccacatcatcggctcagacataacccagtacctctacttttacatggtgttcctgcagccaggcaatggcggcttgcgtatcttgttgtgtgccgtgcatttcagtcagcatgatgccgaacttaacgccaccggcgtaatccatctgcgcgctaataatgttgttgttgacgttgaaacgacgcgcggtttcagaaagcagtggggcatcgaccgattgaccggtaaactccagacgcagcatcggcacgcagtcagtaaatggctccgcttgcagacgttcctggtaatcttccgggatatccagatgcagggtcgactgaataaacttctgcgccagcggcgttttcggatgcgagaacacttcacttaccgtgtcctgctcgatcagttctccattgctgatgaccgccacgcaatcacaaatgcgcttcacaacgtccatttcgtgggtgatcaacagaatcgtcaaccccagacggcggttgatgtctttcagcagttcgagaatagaacgtgtcgttgccgggtccagcgcgctggtggcttcatcacacagcaatactttgggattgctggctaacgcacgggcaattgccacacgttgtttctgcccaccggaaagattcgacgggtagctatcatgcttatcgccaagaccaaccaatgacagcaattccgtcacgcgacgtttgacctcgtctttcggtgtgttgtccagctccagcggcagagccacgttgccaaaaacagtacgcgaagagagcaggttaaaatgctggaaaatcataccaatctggcggcgagctttggtcaactcggattctgacagcgtggtcagttcctggccatcgaccagcacgctaccctcggttgggcgctccagcaggtttacacaacgtataagcgtactcttacccgcgcctgaggcaccgataacgccataaatttgtccagctggcacatgcaggctgacgttgttcaacgcctggatggtgcgggtgccctggtggaacactttggtgatattcgaaagttttatcattgattatttattatcgtcattaagttagtcgtggcatctcgaatgcctgaaacgggcaacgccgtcaatgaaatggatgttaaggcatccagacgtctaaatcaatcaggtttatgcgaagagcactttcttgcaggtcgaaacatgcgatactagcgtcacatgccttattaaggagctataaaaggtggcgaagagcgtacccgcaatttttcttgaccgtgatggcaccattaatgtcgatcacggctatgtccatgagatcgacaactttgaatttatcgacggtgttattgacgccatgcgcgagctaaaaaaaatgggctttgcgctggtggtagtaaccaaccagtctggcattgctcgcggtaaatttaccgaagcacagtttgaaacgctgaccgagtggatggactggtcgctggcggaccgagatgtcgatctggatggtatctattattgcccgcatcatccgcagggtagtgttgaagagtttcgccaggtctgcgattgccgcaaaccacatccggggatgcttttgtcagcacgcgattatttgcatattgatatggccgcttcttatatggtgggcgataaattagaagatatgcaggcagcggttgcggcgaacgtgggaacaaaagtgctggtgcgtacgggtaaacctattacgcctgaagcagaaaacgcggcggattgggtgttaaatagcctggcagacctgccgcaagcgataaaaaagcagcaaaaaccggcacaatgattaaaagatgagcggttgaaataaaaatgcatttttccgcttgtcttcctgagccgactccctataatgcgcctccatcgacacggcggatgtgaatcacttcacacaaacagccggttcggttgaagagaaaaatcctgaaattcagggttgactctgaaagaggaaagcgtaatatacgccacctcgcgacagtgagctgaaagccgcgtcgcaactgctctttaacaatttatcagacaatctgtgtgggcactcgaagatacggattcttaacgtcgcaagacgaaaaatgaataccaagtctcaagagtgaacacgtaattcattacaaagtttaattctttgagcatcaaacttttaaattgaagagtttgatcatggctcagattgaacgctggcggcaggcctaacacatgcaagtcgaacggtaacaggaagaagcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcttttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgtactttgcagtgctcacacagattgtctgatgaaaatgagcagtaaaacctctacaggcttgtagctcaggtggttagagcgcacccctgataagggtgaggtcggtggttcaagtccactcaggcctaccaaatttgcacggcaaatttgaagaggttttaactacatgttatggggctatagctcagctgggagagcgcctgctttgcacgcaggaggtctgcggttcgatcccgcatagctccaccatctctgtagtggttaaataaaaaatacttcagagtgtacctgcaaaggttcactgcgaagttttgctctttaaaaatctggatcaagctgaaaattgaaacactgaacaatgaaagttgttcgtgagtctctcaaattttcgcaacacgatgatggatcgcaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgcgcgatacagggtgacagccccgtacacaaaaatgcacatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcatgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaactcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagcctgtgaaggtgtactgtgaggtatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggttagcgcaagcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttgacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaagctgttttggcggattgagagaagattttcagcctgatacagattaaatcagaacgcagaagcggtctgataaaacagaatttgcctggcggccgtagcgcggtggtcccacctgaccccatgccgaactcagaagtgaaacgccgtagcgccgatggtagtgtggggtctccccatgcgagagtagggaactgccaggcatcaaattaagcagtaagccggtcataaaaccggtggttgtaaaagaattcggtggagcggtagttcagtcggttagaatacctgcctgtcacgcagggggtcgcgggttcgagtcccgtccgttccgccacttattaagaagcctcgagttaacgctcgaggttttttttcgtctgtatatctattattgccagaatcgcaaaaatcctctgcattttacgctctttttcctcaacagtctgaagcccataatcacctcagttaacgaaaatagcattaaaagaggcatattatggctatccctgcatttggtttaggtactttccgtctgaaagacgacgttgttatttcatctgtgataacggcgcttgaacttggttatcgcgcaattgataccgcacaaatctatgataacgaagccgcagtaggtcaggcgattgcagaaagtggcgtgccacgtcatgaactctacatcaccactaaaatctggattgaaaatctcagcaaagacaaattgatcccaagtctgaaagagagcctgcaaaaattgcgtaccgattatgttgatctgacgctaatccactggccgtcaccaaacgatgaagtctctgttgaagagtttatgcaggcgctgctggaagccaaaaaacaagggctgacgcgtgagatcggtatttccaacttcacgatcccgttgatggaaaaagcgattgctgctgttggtgctgaaaacatcgctactaaccagattgaactctctccttatctgcaaaaccgtaaagtggttgcctgggctaaacagcacggcatccatattacttcctatatgacgctggcgtatggtaaggccctgaaagatgaggttattgctcgtatcgcagctaaacacaatgcgactccggcacaagtgattctggcgtgggctatgggggaaggttactcagtaattccttcttctactaaacgtaaaaacctggaaagtaatcttaaggcacaaaatttacagcttgatgccgaagataaaaaagcgatcgccgcactggattgcaacgaccgcctggttagcccggaaggtctggctcctgaatgggattaagcctctctgacagctcctccgggagctgtttttacatgctcgctaaggaaatcgataaaagcccggatgcgcgtacttaccgcacggtcgctgtaatagacggcactgaatggcatttccactggcaacactttatctgccattaactccaccaattctccgcgagcgatttctttgtcgatcatgtagtcggacaaacacgcaatcccgttgccactcaggcaaagctgtttcagtgtttccccactattggatgacaaaccgtacttcacctcatgtaattgtccatcgctacgggctatcggccaggtattgagggaagcgggttcagtgaatcccaggcaaatatgttgctttaaatcgtcgatcgtttctggcttcccgtagcgggaaatataatcgggggaggcgataatttttcgataactgttaaataacggcctggcacgtaagctggaatccgttaacgtaccagcgcgtatcgcgacatccacttttctttcgatcaaattaataatcgtttcggaggagactagcgacaaagtgacttccggatagcgttcacggaaaggcttaattaacggcatcagaaagtgcagcaccactggagttgcggcatcgatccgtaacagtccacgcggtgtattacgcgtctccataatttctgattctgccgctgccatctcctgcaaaattgactgtacgcgacgaaaataacgctcgccttcttccgtcaggctaagttgtcgcgtggtccgattaagcaggctaacgccaagtttcatctccagctttttcaccgcccggcttaccgctgagtttgcttgccctaattgttccgctgcccggctaaagctgccgctttcgacgaccgaaacaaaaatggcgagttcttccgacgtggctttcatttttgctcctgttgcaaaatagaagagatattttgaatttatttgtcattaaaccatcaggatgcgtgatatgtcatgcgatttaatgttctccataatgagcaaaattctgaccggtgtaagcacttgcttacataacaatatacaattgctcgttgaaagagtgagctaaaatccctataacagtagaaccctcccgagtgcggaagggttgacgtaatagaggtttcaaagtcaaaagtgcgaaaaaacacctatgccatgcgctatgttgccggacaacctgcggaaaggatcttaccgccggggtcttttgcgagcatcggccaggcattaccacctggggaaccgttaagtaccgaagagcgtattcggatcctggtgtggaacatatacaaacagcaacgcgctgaatggttgtcggtattaaagaactacggcaaagatgcacatctggtgttattgcaggaagcgcagacaacgccagagttagtacagtttgcgaccgctaactatcttgccgccgatcaggtacccgctttcgtgctgccacaacatccttctggcgtaatgaccctttcggcggcacatccagtgtattgctgcccgttacgtgaacgagaacccattttgcgtctggcgaagtcggcactggtgacggtctatccattacctgacacccgcctgttgatggtggttaatatacacgccgtcaacttcagtctgggcgtggatgtctatagtaagcagttacttcctattggcgatcagatagctcaccacagcggcccggtcattatggcgggagatttcaatgcctggagccgtagaaggatgaacgcgttatatcgctttgcgcgggaaatgtcgctgcgccaggtgcgttttaccgatgatcagcgccgtcgggcgtttggtcgcccgctcgattttgttttctaccgtggtctgaacgtcagtgaagcttctgtactggttacgcgcgcttccgatcacaatccgctactcgttgaattcagtcccggcaagcctgataaataaggtatgtcaggtctgccacagggcagaccaacgtttggcgctgcgcaaaacgtgagcgcggtggtggcgtatgacttatctgcccacatgctggatgtcgtggcacaagctgccgaagcccggcaactgaaaaatatcaccacccgccagggatatgccgaaagtctgccatttgccgataacgcatttgatattgttatcagccgttattctgcccatcactggcatgatgttggtgcagcactgcgagaagtgaataggatattgaaacctggcggtaggctgattgtgatggacgtaatgtctccgggtcacccagtgcgcgacatctggttacagacggtagaagcattacgcgatacctctcacgtacgaaactacgccagcggtgagtggttgacgttaatcaatgaagccaatctgatagttgataatttaattacagataagttaccgctggaattttcttcatgggtcgcgagaatgcgtacgccagaagcgttagtagacgctattcgcatttaccaacagagcgcatcgacagaggtgagaacgtattttgccttgcagaatgatggctttttcaccagtgatatcatcatggtagatgcacataaagcggcataaataaaaaaggcaccgggggaatcggtgcctttttattatctggtttgtcaggaatctggcatgttgttgtttttcacaaacaacgtcagcttatcgcctggttgcagattcgcagtgtcgctgttccagcgcatcacatctttgatgttcacgccgtggcgtttagcaatgcttgaaagcgaatcgcctttgcgcacacgatacgtaatgctatcgctgttgtttgccagtcgctgtgcgctactgcctgcaccaatcgtcaaactttggcctggcttcagcttagatccgcgcagtttgttccactgctgcaaatctttggtgcttacgccgagacgtgaagcgatacttgaaagcgtgtcgccagagcgtacggtgtaaacacggctgttaagcggcgtattgtcggcaaccagcgtcgactgtacagcagcaatttcgcctgaagccagagattcacgcagttgatctgcatgcttctttggcaccatcacgtactgcgggccacttgcgcccagcgtggagccttttacgccagcgttgaatgtcttcagcttgctgacggaaatccccgccatatctgctaccttcgccatttcaaccgggctgctcaggtgcacacgcgccagagcacggctttcatcggtcgttggcagacgtacgccataacgcttgctgtttttgagaatatcactcaatgccagcattttaggcacgtactgcttcgtttcctgcggcaacggtaacgaccagaagtccgtggatttcccacgcgctttgttcgttttaattgccttcatgacccgaccttcgccgctgttataagccgctacggtcagaagccagtcgccgtcaaacattttgttcagacgctgcatcatattcagcgcggcagttgttgaagcaacaacatcgcgacgcgcgtcataattgcgggtctgtttcaaaccataattgcgccccgtgctcggaatgatctgccagatgcctgcggcattggcgccagacgttgcgtgaggatcaaaagcgctctccactatgggtagtagtaccagttccataggcatgttacgttttttaacttgccctgctatccagtacatatacggctctgcccgtaaagttacatcgtggagatagctcttattgcgtaaatatttctgtttctgttcgcgaatccggtcattttccggaattcccatctttagctcgtcgccaatgaaagcccacaagtcaccatctggcgcgatagacgtcccatcgtccatccatcgtgcctgacttgtaaactttgctgcttccccttgaccagctgcagaaaggctctgtgcgtgctgttgaacgttgccggtactctggcaacccacgagcaggacagaggcgagtaatatcgcttttgccttcatgtgtgtgtcaatagttgcttaaaagacgaccgatcataacggcgaacggagccgatgacaagaaagttttatcagaacctatctttctttgaccttaaccatgcaaaacgctcttcaggttgttgcaataatgtttcttcattaattacattaattaaatcaatatcttccgttcttaaaaaaacattaatttgccgctcatttttcagaattacgggtagtgttatttgattttttgcccgtaactccttaactttacgataataatcatttatggacaaatcgtgcggaagaatactcaaagcaaacttcatatttgataaggtatattcatgagcacaacataccaatgtatcgtcaggtaacgcacttaactttttaagtgattgatacatttgtgatgctgtcccttcaaacaaccgaccacacccaccagaaaacagtgtgtcgccgcaaaatagataaggtttactgaagtaacagatatgtcctaaagtgtgacccggcgtagcaattacactaaattcatgccccaaaacgaaggcagtttcgccatctttgactacctgtgttgttcccttatcttgtgtctcttgtggaccatacaccacaatttgtggaaacttttccaccagttcttttacgccgccaacgtgatcgtggtgatggtgggtgagaaatatggcctccggttgccagttattggcggcaatggcgtttaatactggctctgcgtctccgggatcgacaatcaggcagcgacctgcttcatcattcaaaacccagatgtaattgtcatcaaaggcgggaatactgttaagattcatagattacctctcagtgtgaaacggaaggttgtgatgaaaccggcaagagtccctcaaactgtcgtggctcctgattgctggggcgatttgccctggggaaagctttatcgcaaggcgctggagcgccagctcaacccgtggttcactaaaatgtatggttttcatctgcttaagattggcaatttaagcgcagaaatcaattgcgaagcgtgcgcggtttctcatcaagtgaatgtttctgcgcaaggaatgcccgtccaggtacaggcggacccacttcatcttccttttgccgataaatccgttgatgtttgtctactggcacatacattgccgtggtgcaccgatccgcatcgtttattgcgtgaagccgatcgggtattgattgatgatggctggctggtcattagtggcttcaatcccatcagttttatgggattacgcaaacttgtgccggtattgcgcaaaacctcgccctataacagccggatgtttactctgatgcggcagctggactggctctctttgttgaattttgaagtgctacacgccagccgtttccacgttctcccgtggaacaaacacggaggaaaactattgaatgcgcatattcctgcgcttggttgcttacaacttattgttgcccggaaacggactattcctttaacgctaaatccgatgaaacagagtaaaaacaagccacgaattcgccaggcggttggagccacccggcaatgtcgtaaaccacaggcttaaacttcaacttggtagcctgtatcttccagtgtgggattcatcgccgcggcacgagccagttcatcacagcgttcgttttccgggtgtccggcatggcctttaacccattcccatttgatttgatgctgccccaatgcagcatcaagacgttgccagagatcgacattttttactggttttttgtctgcggttttccagccacgttttttccagttatggatccactgggtgataccctggcggacatactggctgtcggtactcaaaatgacttcgcaatgttcttttaacgcctccagcgcgacaatagcggccatcaactccatacggttgttggtggtgcgggtgtagccagcgctaaaggttttctcgcgtccgcgatagcgtaaaatagcgccgtaacccccaggtcctggattgcccagacacgaaccatcggtgaaaatttctacctgtttaagcatctctggtagacttcctgtaattgaatcgaactgtaaaacgacaagtctgacataaatgaccgctatgagcactgcaattacacgccagatcgttctcgataccgaaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataaatacctgtgaaaggcgctaaaaatagcgacttgggcgatttttgcagcaaacgattcaaaagatgagaaaaaccgttgacgaaggtcgaggcaatccgtaatattcgcctcgttcccaacggaacacaacgcggagcggtagttcagtcggttagaatacctgcctgtcacgcagggggtcgcgggttcgagtcccgtccgttccgccactattcactcatgaaaatgagttcagagagccgcaagatttttaattttgcggtttttttgtatttgaattccaccatttctctgttcaatgattttactctggcgtaggtgcgtgattctcgcttgttgtctcattcattaaaattcaataatgatatcgaaccattcagcttaaatatatttctagagaataaatttatattgattaaatgaatgtatatttcaaattgattttgtttgttattatttaagtgaggtatataattagagtccgttatcaatgctaaatattctaatcattatgacaggcgagggagtgtccaattatgaattcaaaaaagctttgttgcatatgtgtgttattctcgctgcttgcaggatgtgcctctgaatcttctattgatgaaaagaagaaaaaagctcaagtcacacaaagtaatattaataaaaacactccccagcaactgacagacaaagatttattcggtaatgaaaccactctggccgtatccgaagaggatattcaagctgcgcttgatggagatgagttccgcgttccccttaattctcctgtaatacttgttcaatccggcaaccgcgcaccggaaaccattatgcaggaggagatgcgaaaatattatactgtttccacattctctggtatcccggacaggcaaaagcctctgacttgtaacaaaaacaaagataaaaatgagaacgaggatgttgccagtgctgagaatatgaactggatgcaggcactgcgttttgtggctgcaaaaggacatcagaaagcgattattgtttaccaggatatgttgcagacaggaaaatatgactctgcgctgaaatcaacagtatggtccgactataaaaatgacaaactcactgacgctatctccctgcgctacctggtacgtttcacgctggtggatgtggcaacaggtgagtgggctacctggtcgccggtgaattatgaatataaagtgcttccaccattgcccgacaagaatgaagccagtacgactgatatgacagagcagcaaatcatgcaacttaagcaaaagacctataaagcgatggtaaaagatttggttaaccgctatcaataataaattatatctgccgccaggaatttctggcggcaataatacaaaattctttgcataagaaatttttcttgacaaagacagtgcaagaaaggacatggaatccggagttaaaaactgtttgttttagaatatttaattatttaactgctgaatcttccttgcgagaaatatatccattattacatttcatgccatttttaatatagattgctcctgggaaaattcccgtattattaccgcaggggtgataattagtattgacatatcctgtgacaaaaggagctattaaaggtgctattacgatagctattagtaaaaatataagagttagctgtattgttatgtctgtggcgaaattgactaccttcgtttttttgattaagaatgattttattatcgtaagtaaaattacatgaatatttaaaaaggaaaacgacatgaaaccgaagcacagaatcaacattctccaatcataaaatatttccgtggagcattttattattgaatatagaggtttaactccggtaaaaaacaaagaagcattgaatgcagggaaaaataatatggccataaaaaacatcgaaagaaactcttttaatttaacatgtaaacgcatggttaatcctcatatcacgggtggagtgttaagaacatacataaatggagtcatgttttcccttttccatttatcaagttcctgttgccgttttagtccatctctaattgcatattttaatttttctgataaatggcattgagcatcgatttcatttaaaacaactgtacacactatccctgtcagtaaaattgctcctccgacaagaattactggaaagccaaagctaacacaggcaaaagaagccagacttccaatagcggttgcaacaccaccggctataactgctttggccacatccattgaaaaatcgccaagaaaattaaccagatctcgctctgaactcataataaattctatggttctgctgatttaaccgcagagaagttcgccacagcaatccgaaaccactggcacgtggagaataagctgcacaggcgtctggacgtggtaatgaatgaagacgactacaaaataagaagaggaaacgcagcagaattattttcagggatacggcacattgctattaatattttgacgaatgagaaggtattcaaggcagggttaagacgtaagatgcgaaaagcagccatggacagaaactacctggcgtcagtccttgcggggagcgggctttcgtagtaataccccgactctccccgtccttaaacacaacccccactcaccacaacctaaactcatccgcatcctgccatgccggaaacttttctctatattcccgcaatgctgccatcgacagctccgcatcaatgcgcgttgcctgatgcgcgtcggcagtagcgataatctctccttgcggattaatcacccggctgtcaccgcgataatggcagccgttgccatcgctgccgacgcgattgcatcccgccacatacgcctgattctcaatcgcgcgggccgtcagcaatgcctgccagtgcagagagcgcggagcaggccagttggcgacgtacagggcgaggtcataatcgttgagattgcgcgaccacacaggaaaacgtaagtcgtagcacaccagcggcaaaatacgccagccgcgccattccacaatcactcgcgcattgcccgctttataatgtagatgctcatctgccatgcggaacagatgacgcttatcataaaaatgtaccgtgccgcccggctcaaccagcaaaaagcggttaaccgaaccagactccgtttgtaatgcaacactgcctgcaatcagcgcattgcactgctgcgccttagctgtcatccagttcactacgtcatcttgtgctagcgacgaagctgccgcttccatggcaaagccgctggtaaacatctccggtagaacgatcacatcgcgcccggtaataccttccagttgacgatcaaaatgacgcaggttggcaggaccatccatccacaccagtggttgctgcaaaagcgtaatcttcaaaccaggcacggtgtacaactcctttatgcgaagggttttataactttaacaccttatcaggcagttgccttagcgcagaataaattgataacaaatgctgatattggaaatatctgatttgcaaattatcgtgttatcgccaggctttaggaggttaataacatgggcaggataagctcgggaggaatgatgtttaaggcaataacgacagtcgccgctctggtcatcgccaccagtgcaatggcgcaggatgatttaaccattagcagccttgcaaagggcgaaaccaccaaagctgcatttaatcagatggtacaagggcataagctgcctgcctgggtgatgaaaggcggtacttatactcccgcacaaaccgtaacgttgggagatgagacgtatcaggtgatgagcgcgtgcaaaccgcatgactgtggctcgcaacgtatcgctgtgatgtggtccgagaaatctaatcagatgacggggctgttctcgactattgatgagaaaacgtcgcaagagaaactcacctggctgaatgtgaacgatgcgctttcgattgatggtaaaacggtgttgttcgcggcgttgaccggcagcctggaaaaccatccggatggctttaattttaaataattagcggataaagaaacggagcctttcggctccgttattcatttacgcggcttcaactttccgcactttctccggcaactttaccggcttcgtcgccagctcttccggatcaaagtcatcaacgttaatactgcgcagacggctttcttcagctttcaccagaatagcggcttcatctttatcaatcagccccttcaccagcgcgttgtgcgccagttcatccagacgggtaaacggcaggtttttacccagctctttacagatccgctgatgaattgggtcggcggcaatcacatccaccagcgcctcttccagcaagccaaccggattatgctcgctcggcgtcaggtactgaccgcgaccaatgcgggaacgggtggcgttcggcacttgtaaaatcttcgccactttatgatccagcttgtcagaaggtgccagataatgacgtccggtcgggaagatcaccacattcagcagcccggcaaccacgcggttcgggaagttttgcagtaaatcatccatcgcctgttcagcctgatacagcgcatcttgtacgccccagtgcaccagcggcaggtcggcttcattacggccttcgtcgtcataacgcttcagcacggcagaggcgaggtagagctggcttaaaatatcccccagacgggccgagatgcgctcgcgacgtttcaggctgccgcccagcactgccatcgagacatcagaaagcagggcgaggttggcgctcaggcggttcaggtgctgatagtagcgtttagtggcatcgccggttggcgtgctgctggttaaaccgcgcgtcaggcccagccagaagctgcgaactttgttgctaccgacgtgaccgatatgtttgaacaacagtttatcgaacgcgttgacgtcattgttcttcgccgcttccatctcttccagcacgtacggatggcaacgaatcgctccttgtccgaagatcatcatgctgcgggtcagaatgttagccccttcaacggtgatggcaatcggtgcgccctggtaagcacgcgccaggaagttgctttgcccgagcataatgcctttaccgccggtaatatccatcgcatcaataatcgactgctgcccgcggtgggtacagtgatacttaacgatagccgacagcacggcaggtttttcgccgagcataatgccgtaggtaatcagcgatgccgcagcatccatcacgtaggcattaccggcaatacgcgccagcggctcttcaatcccttccatcttaccaatagagattttgaactgacggcgaatgtgagcatacgcgccggttgccagcgctaccgatttcacgccgccggttgagttggaaggcagggtgatgccgcggcctaccgagaggcactccaccagcatccgccagccttgcccggccattttcggcccgccgatgatgtaatcgatcggcacgaagacatctttaccgcgcgtcggtccgttctggaacggtacgttcagcgggaagtggcgacgaccaatttccacgcccggcgtggtggttgggatcagcgcacaggtaatgcctaaatcttctgcaccgccgagtaatttttccgggtcggagagtttaaacgccagcccaagcacggtcgcaatcggtgccagcgtaatgtagcgtttgttccaggtcagacgcatccccagcacctgctggccctgccattcgcccatgcagacaatcccggtgtccggaatcgcgcccgcatcggaacccgcttccgggctggtcagtgcaaagcaggggatctcctgaccacgcgccagacgcggcagatagtgatctttctgctcgtcagtgccgtaatgttgcaacagttcgcccgggcctaatgagtttggcacgccgacggtaatcgccaggatcccgctcacgccggagagtttttgcagcacgcgagactgggcataagccgagaactccagcccgccgtactcttttttgatgatcatcgcgaagaaacgatgctctttaaggtacgcccacaactccggcggcagatccgccagctcatgggtgatctggaaatcattcgccatccggcaggcttcttctaccgggccgtcgagaaacgcttgctcttcggcggtcaggcgcggctgcggatagttatgcagctttttccagtccggcttgccctggaacaagtcgccctcccaccaggtggtgcccgcatcaatcgcttctttctcagtgcgcgacatcggcggcatcaccttacggaaaccgcgaaataccggcgcggaaatcatcgacttacgcataggcgcaaagttaaatggcacgaggataatggccagaggcaccagtacccacgccgaccacagaccagcaacgccgagggcggctgtccaggcgagcaaaatcagactgctgataaataagctcacgcggtgatagaacaacgcgccgagcaggacaaccgtagcgagaatactcaaaatcatcataacgaaaagccccttacttgtaggaggtctgaccacttgtgatgatatggttgtagtggatgtaaaaacatttagcaatatgtttacaatataattacaacaaagctcacattgttgctgtttttatccgcacttcaggtcaaaaagtcctggtcatagcacctgcccgtacttctcgcttttggcggtatccggtacactgcattttgtctattacatttatgctgaaggatatcctcatgtaccaggatcttattcgtaacgaactgaacgaagcggcggaaacgctggctaactttttaaaagatgacgccaatattcacgccattcagcgcgcggcggtcctgttagcagacagctttaaagccggtggcaaagtgctttcctgcggcaacggcggttcccattgcgacgctatgcactttgccgaagagttgaccggtcgctaccgtgaaaaccgtccgggctacccggcgattgctatttctgacgttagtcatatttcctgcgtcggtaatgatttcggtttcaatgatattttctcccgctacgttgaagcggtaggtcgcgaaggcgatgtactgctggggatctccacctccggtaactctgcaaacgtgatcaaagcgatcgcagcggcgcgtgagaagggaatgaaagtgatcaccctgaccggtaaagacggcggcaaaatggctggcacggcggatatcgaaattcgcgtaccgcactttggttatgccgaccgcattcaggagattcacattaaagtgatccatatcctgatccagttgattgaaaaagagatggttaagtaagtctggcgtaggccggataagacgtttacgccgcatccggcatttgtgcgctgatgcctgatgcgacgctgacgcgtcttatcatgcctacaaatctgtacgcgaaccgtaggccgaataatgcgttcacgccgcatccgacctgaaaattcttaaatcaatcttcgccgggggccatgcgctcccgctgttgtggaggttacccatgtgcgaattgctcgggatgagcgccaacgtccctaccgatatctgctttagtttcaccgggcttgtacagcgtggtggtggaaccgggccacataaagatggctggggcattaccttttacgaaggtaaaggctgtcgcacatttaaagatccacaacccagctttaattcccccatcgccaaacttgtccaggactacccgataaaatcctgttcggtggtggctcatattcgccaggctaatcggggcgaggtggcgctggaaaatactcacccatttacccgcgagttatgggggcgtaactggacttatgcccataacggacaactgacgggctacaaatcactggaaaccggcaacttccgcccggtaggcgaaaccgacagcgaaaaagccttctgctggctcctgcataaattaacgcagcgttacccgcgcacaccgggcaacatggcggcggtatttaaatatatcgcctcactggcggatgaactgcggcagaagggcgttttcaacatgctgctttcggacgggcgctatgtaatggcgtattgctcgactaatttacactggatcacccgccgcgcgccgtttggcgtggcaacgttgctggatcaggatgtggaaatcgacttcagctcgcagaccacaccgaatgatgtggtcacggtgattgcaacacagccgctgacgggcaatgaaacctggcaaaagattatgccaggcgaatggcgcttattttgcctcggggagcgtgtagtttgatgccagttgtggctgcacaacttcgtggcttaacggcttgctgaccacgtaacgaccattgaccacagaaacggttggtggcttacgggtttgctcaaagtagtcgtaacccggcttcagttgctcccagaagtccttaaagttggaatatttatggcgcttcatattggcgtcggtcatgcggaacgggtaaatactcacttgcacgctcggctgaccaaacaccagcgcaccagtaacgaactggaatatctcatcaataccctgattggtcattgcgtagcagccgatggaaacacaatcgccgtggatcatcaggtatttcccttcataaccatgcgcacggtcataggcattggggaaaccaatattaatcgctttgtagtaacggctgtctggttttaactgattacgctggacgctataaaacccttccgggcttttgaaatcgccctgacgctgttttggccctaagccgccggaatatttacagattttatagctgtcgagcagttgatattgctcgcccattttgacgtagagatcgagcgtacgttcttccttgaagatctggatgtagacaggggatcccatcaactgctgcttatactctttgctcacaggcgtggtagagctactgctgcccagcaaaccggcaaatgaaacgcacgggatcaacaacatcgcaagaattaatgcgattttacgcatactgcttattccttgataaaacggttacacacgccaggacggcaaaatggatcccaaatcggaatagtctggatttggaaggctcacattatcaccaaaagagttttacgcaagcctgtcggcgcagggtttacaaatttcatcggaagcgggctttacccaaagagcgccgcgtgagttccagttctctcaaatcgtaaaagtttatcggtaagtttgtaaatcaggatccagtccggttcgacatgagcatcgcgataacctttccatgaaccttgcagcgggtggtctttataaacagctggaagcggtaaagtattattgataagaagcgtcataagatatttcaatttattcatatccttatgacgcttttgtgcaagttttacatcctttgaatattgtcccgagtattcaatatccctttgaatcatatttaaattcctaatttatcaaataaatcatcggcgtctttggccttatgaacatcaatgccagcttcgctgtttttgattgattgaatggttaattgattaggctcgcgtaaatcaaacggcaatgccttttcacgcgcgacctttgtgagggttatgcgaaccaggtcagagatggtcagccccatcccggccagtacgtccgctgcctgattcttcagatcttcatcgattcgggcgcgaacaaacgcgttagcagccattggggtatctcctgtgctgtatatttattcagcttgaattgtagctcaaatgagcaacagcgacaatccatgagtaatttaataaacggatgtttttacataattaactgaaatatatatgttaattttataataatggtttattaagtttgttcagaaacgatccgggatacactgcaacattaaagcatgaccagccattattgagtatgtccttgccgtcgattccatcctttgtattgtcgggattactgttgatttgtttgccgttttcttcatttgccagcgccaccacatcacatatctctttcagctacgccgcccgccagcggatgcaaaaccgtgcgcgtttattaaaacagtaccaaactcatctgaaaaagcaggccagctatattgtggaaggcaatgccgaaagcaaaagggcgctacgccagcacaaccgggagcagataaaacagcatccagaatggtttcctgctccgctcaaggcgagtgacagacgctggcaggcgctggcggaaaacaaccactttttaagcagcgaccatctgcataacattaccgaagtggcgattcaccgcctggagcagcagcttggcaagccttacgtctggggcggtacgcggcctgataaaggctttgactgtagcgggttggttttttatgcctacaacaagatccttgaggctaagctcccgcgcacggccaatgagatgtaccactatcgccgggcaacgattgtggcgaacaacgacctgcgccggggagatttgctgtttttccatatccacagccgcgagatagccgatcatatgggcgtgtatttgggcgatgggcaatttatcgagtcgccacgtaccggcgaaaccattcggataagccgattagccgaacctttctggcaggaccattttttgggcgcgcgcaggattttgacggaagagacgattttgtaggacggataaggcgtttacgccgcatccggcagttgtacgcaggtgcctgatgcgacgctggcgcgtcttatcatgcctacgagcccgcgaatatttgcgagccgctttcccgatataaaacaacctcattgccaacctttccttttcttcttaccgttgagaaaaaggagtcgccatgtctgaatatcgtcgttattacatcaaggggggaacatggtttttcacggtgaatttacgaaatcgtcgaagccaacttttgaccacccagtaccagatgctccgtcacgccattattaaagttaagcgagacaggccttttgaaatcaacgcctgggtcgttttgccagagcatatgcactgtatctggacattacctgaaggcgatgatgatttttcctcgcgctggcgggaaattaaaaagcaatttacccatgcttgtggattgaaaaatatctggcaaccacgtttttgggagcacgccatccgcaataccaaagattataggcatcatgttgattatatttatataaatccagtaaagcatggttgggtaaagcaagtgagtgattggccattctcaacgttccatcgcgatgtcgcgcgagggttatatcccatcgattgggcgggggacgtaacggattttagtgccggggagcgtatcatttcataattgtgcgcagatgcctgatgcgacgctagcgcgtcttatcatgcctacaaacttgtgccggatcggtaggccggataaggcgtttatgccgcatccggcagttatgcgcagatgcctgatgcgacgctggcgcgtcttatcatgcctacaaacttgtgcctgaacggtaggacggataaggcgttcacgccgcatccggcagttgtgcaccaatgctggatacttacatcaacgcccccataatcttcaactccagctcatccggcacttcgttatacgacagcacatgcagccccggcgcaaacaaccttgcataacgcgccagcaaagggcgcagctgcggtggcaccagcagcaccgggtctttccccgccgctttcatctgctctttcacctgtggcatcgtactctggaactggttgagcatattcggatcgaccggcacgctgtcgagcatcactttcccgccctgttgcgcctgattcaccacgttggtcagcagattttccagctcattattcagcgtatacaccgtcagctcctgcttgcgaacgaacggatgggtaatgctgcgccgcaatgccaggcgcacatcggccgccagcagaatatgatctttcgtcaccgtgctactggcgaccagcacggtggcgatggtgacgatatcgcgcagggaaacgccttcggtcagcagcgcccggtacactttcagcaactggctgtaattgagcgccgcgctcaaatcttccgccagacgcggtgccgtcgacgataaacggttatgcaactgcgtaatatcatcatagttaaacaaatcaggaatatagctgcgcacaatcttatttacatgggtagcgatcacgctggcgctgtcgatcacctgataccccatattcagcgccttcgctttctgcgccgcctggatccaggtgaccggcatcccgtacgccgggtcgttcccctgcacgccgtcaatctcgccgtaggtttcgctggagggcagggccatcagtttatccgccggaatatccgcttcatcagcctttatgccgttgatgaaaatggcgtactgactgggcttaaggcggaagttttcccgaatgcggatctccggcagcagcacgccgttgccgtcagaaatcacctgccgcacgccgcgaatccgctgggtgagcgggttaccctgtgctttgtccaccagcgccaccagtttgtaaccgaggcttaaactgataggctcgatcagcggaatggtttcccaactgacctgctgctcgctggtttcggtgatggtgcgggtcagcgtttcgaggcttttctcttccgcctccgccgccagcggctgtttgctcatccgccagccggtaaaaccaagcagggcgctgaacagcaaaaacggcaggtgcggcattcccggtaccaccgccagcacgaacataatcccggtggcggtgtagagcaccgacgggcttgccagcagctggttacgcacgtcatgggcgatatcgccgttgtcgctgacgcgggtgacgataatcgccgccgcggtggagagcagcagggaagggatctgcgccaccaggccgtcgccgatggtcatcagcacatactgctggaaggcagcatcggcgctcaggttgtatttgaagatcccgatacagacgccgccgatcaggttgatcgccagaatcatcatcccggcgatggcgtccccgcgcacaaacttcgatgccccgtccatcgcgccgtagaaatcggcctcgctggcaacatctttacgccgggtttgcgcctgcgcctggttgatcaatccggcgttaagatcggcgtcaatcgccatctgtttgccgggcatcgcgtctaaggtaaagcgggcagaaacctcggaaatacgctcggcccctttggtgacgacaataaagttgattgtcaacagcgtcagtaaatccgagcgtgaaagcattatcgccgcgctgcacgggcagtcgatttttaacggtggtgggctgtcgccgttaaataaaatcagcccgtctcatccgccaaaacctgccaccgtggcggtgccggaagagacggagaaaaaagcgcgtgatgtgaatgagaaaacggcgctgctgaagaagaaatccgccaccgagcttggtgagctggcaaccagtatcaacaccattgcccgtgatgcgcatatggaagcgaatctggagatggagattgttccccagggattacgcgtgctgattaaagacgaccagaaccgcaatatgtttgaacgcggcagcgcgaagattatgccgttctttaaaacgctgctggtggagctcgcgccagtgttcgactcgctcgataataaaattattattaccgggcataccgatgcgatggcctacaaaaacaatatctacaacaactggaacctttcgggtgaccgcgcgctttcggctcgtcgggtgctggaagaggccggaatgccggaagataaagtgatgcaggtaagcgcaatggcggaccagatgctgctggattccaaaaatccgcaaagcgcgggcaaccggcgcattgagattatggtgctgaccaaaagtgcgtccgatacgctgtatcaatactttggtcagcatggggataaagtggtgcagccgctggtgcaaaagctggataagcagcaggtgctttcgcagcgaacgcgttaaatgctgaatctttacgcatttctcaaaccctgaaatcactgtatactttaccagtgttgagaggtgagcaatgcgtaaaatcattcatgtggatatggactgctttttcgccgcagtggagatgcgcgacaatcccgccctgcgcgatatccctattgctattggcggcagccgcgaacgtcggggggtgatcagcaccgccaattatcccgcgcgtaaatttggcgtacgtagcgctatgccgacagggatggcgctcaaattatgcccacatctcaccttgcttccggggcgctttgacgcctacaaagaagcctcaaatcatatccgtgaaatcttctcgcgctacacctcgcgcattgaaccgttgtcactggatgaggcttatctcgatgtcaccgatagcgtccattgccacggttctgcgaccctcatcgcccaggaaatccgccagacaatcttcaacgagctgcaactgacggcgtctgcgggcgtggcaccagtaaagtttctcgccaaaatcgcctccgacatgaataaacccaacggccagtttgtgattacgccggcagaagttccggcatttttacaaaccttaccgctggcaaaaatccccggcgtcggcaaagtctcagcggcaaaactggaagcgatggggctgcggacctgcggtgatgtacaaaagtgtgatctggtgatgctgcttaaacgctttggcaaatttggccgcattttgtgggagcgtagtcaggggattgacgaacgcgatgttaacagcgaacggttgcgaaaatccgtcggcgtggaacgcacgatggcggaagatattcatcactggtctgaatgtgaagcgattatcgagcggctgtatccggaacttgaacgccgtctggcaaaggtaaaacctgatttactgattgctcgccagggggtgaaattaaagttcgacgattttcagcaaaccacccaggagcacgtctggccgcggctgaataaagctgatctaatcgccaccgcgcgtaaaacctgggatgaacgccgcggcgggcgcggtgtgcgtctggtggggctgcatgtgacgttgcttgacccgcaaatggaaagacaactggtgctgggattatgatgtatactattatgtatattctggtgtgcattattatgagggtatcactgtatgcatcgaattctcgctgaaaaatcggtcaatatcactgagttacgtaaaaacccagctaaatactttattgatcaaccggttgcggttctttctaataatcgccccgcaggatatctcttaagtgccagcgcattcgaagcgttaatggacatgcttgctgaacaagaggagaaaaagcccataaaggcgcgcttccgtccaagtgctgcaagattagaggaaattacacgccgcgctgaacaatatcttaatgatatgacggatgatgatttcaatgactttaaggaataaggatgcgggtattcaaaacaaaacttattcgcctgcaacttacagcagaggaacttgatgcgttaacggcggattttatttcctataagcgtgacggtgttttgccagatatatttggtcgcgatgcactctacgacgactcctttacctggccattaatcaaatttgagcgagttgctcatattcatctggcaaatgagaataatccatttccgccacagttgcgccaattcagcagaacgaatgacgaagcgcatttggtatattgtcagggggcgtttgatgagcaagcatggttgctcattgccattctgaaacctgaacctcataaactggctcgagataacaaccaaatgcataaaattgggaaaatggcagaagcgtttcgcatgcgtttttgaatttatattatgaataacatacaaataagaaactatcagcctggcgattttcagcaactatgcgctattttcattagagcggttacgatgaccgccagtcagcattattcaccacaacaaatttccgcctgggcgcagattgacgaatctcgctggaaggagaaactcgcgaaatcacaagtgtgggttgcgatcattaatgcacaaccggttggttttatttcccgcattgaacattatatcgatatgttatttgttgaccctgaatacacccgccgtggggttgccagcgctttgttaaaacctttgattaagtctgaatccgaacttacggtggacgcaagcataaccgcaaaacccttttttgaacgttatggttttcagacagttaagcagcagcgcgttgaatgccggggagcgtggtttactaatttttatatgcgatataaaccgcaacattaaatccagcttgcaatgaaaataacgcccgcctggtatgtgcgcgttttctgattccacaaactgcaaggaggtaaatcatgacaaatcctttatcaatgactctttgcagacctttccaggattaattctttttttcttgccctggattcgtctgccatttcctgatttttatatttatatactctaaataattcgagttgcaggaaggcgacaagcgagtgaatcgccaggagcttacataagtaagtgactggggtgaacgaacgcagtcgcagtacatgcaacttgaagtatgacgagtataaatggaatggtacatgggcaaatatattcgtcccttatccgatgcggtatttaccatcgcatctgatgacctgtggatcgagagtttagcgatccaacaattacacaccacggcaaatttacccaacatgcagcgcgtagtggggatgccagatttacaccccggacgcggctacccgattggcgcagcgttcttctctgttggtcgtttttacccggcaagacgtcgcggtaacggtgctggaaacagaaacgggccgctactctgacacactgcgttcggcgctggtttctctcgatggcgataacgcatgggcattaagcgaaagctggtgtggcactattcagtggatttgtccgagtccgtatcggcctcatcatgggcgcaaaaactggtttctgggcattgggcgttttaccgctgatgagcaggaacaatcggatgcaatccgttatgagacgctgcgttcgtcggggccgggcggtcaacatgtcaataaaaccgactcggcggtacgcgccacgcatttggcatccggtattagcgtgaaggttcagtcagagcgtagtcagcatgctaacaagcggctggcacgattgctgattgcctggaagctggagcaacagcaacaggaaaatagcgcggcgctgaaatcgcagcggcgaatgttccatcaccagattgaacgtggcaacccgcgacggacatttacagggatggcttttatcgaaggataatgaaggatgaaactgccggaaggcgattaaacgccatccggcagcaaatcaaataattacttcgccggaatttctttcagcagttcagtcagcagtgtccagtaatgacctacgctttcgatgtgaacttgctcatccggagagtgtggaccggtgatagttggcccgatagaaaccatgtccatttccggatacggttttttgaacagaccacattccaggcccgcgtggataatctggatgttcggcgtcttgttgaacaggcgctgataggtttcacgtaccagatgcatcaccggagaattagcgtccggctgccagccaggatatgcgcctttcgcttcggttttcgcgccagccagtttacccagcgaatccagcatgctcaccacgtagtctttaccgctgtcgatcagtgaacggatcaggcagtgaatttctacgttattgtcagtcatggtcaccacaccgacgttcagggaggtttcaaccacacctttggctacatcggagttacgaatcacaccgttcggggtggcgttcagcagacgaataaaggtatcgcgagatttcgcaatcagggcagctttatcgttcgctacagagtccagcaacaaggccagatttttctctttttctgccagctcgtttttcaggatctcctgataggtattcaccagagatttcaggacgtcgactttatcagctgcgacagcaatggtcgcaaaggcttcacgcgggatggcgttacgcagtgtgccgccgttgaaatcgataaggcgcagatccagttcttccgcatgacccgccaggaagcgcaccagcagtttgttggcattacccagcccaacgtggatttccccgccggagtgaccgcctttcagaccttttaaggttaacttgaaggtttcaaaaccagctggaaccgcttcacgatctaaatgcaggttggaggtgaagtcgataccccccgcacaacccatgtagatttcaccttcttcttcggagtcggtgttaatcagaatatcagcctgcaaccagttgccctgtaagccgaacgcaccgtccataccggcttcttcggtcatggtcagcagcacttccagcgggccgtgaaccacgttttcgtcagccagaaccgccagcgcagaggccataccaatgccgttatccgcacccagcgtggtgccgcgcgctttaacccattcgccatcaatataaggctggataggatctttcgtgaagtcatgcacggtgtcgttatttttctgcggcaccatatcgaggtgggcctgtaagacgaccggtttacgattttccatacctgcggtagcaggtttacgaatcaggatattacctacctgatcgcgttcgacatggaaacctttctcttttgcccaaccaacaatgtattcagcgagttgctcttcatgataggacgggtgaggaatagaacagattttggcaaaaatatcccacagcggctgtggagataattgagacagttcagacacgttaagtctccttgtcgatcacccgcaaaacagtattgcaggtcacagggttagcagaaaatgttgtcaacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccacccaggcgatggtgtggcaacaaaaagcctgtgcggaagacgatccgcaactcagtggtcgtcactggctgcatgcggctacgttgtacaacattgccgcctatcctcatctgaaaggagatgacctggccgagcaagcgcaggctttgtcaaaccgcgcctatgaagaggccgctcagcgtctaccgggcacgatgcggcagatggagtttaccgtacccggcggtgcgcccatcaccggctttttgcatatgccgaaaggcgatggcccgttcccgacggtattaatgtgtggtggtctggatgcgatgcagacggactattacagcctgtatgaacgttattttgcgccgcgcggcattgcgatgctgactattgatatgccgtcggtgggcttttcttcaaaatggaagctcacccaggactccagcctgttgcatcagcacgtcttaaaggcgctgcctaacgtaccgtgggtggatcacactcgcgtcgcggcctttggtttccgtttcggcgctaacgttgccgtgcgtctggcataccttgaatcgccgcgtctgaaagcggttgcctgtcttggtccggtagttcataccctgttgagtgattttaagtgccagcaacaggtgccggaaatgtatcttgacgttctggccagtcgtttggggatgcatgatgcttccgatgaagcgttgcgcgtggagctgaatcgctattcattaaaagtgcaaggattgctgggacgtcgctgcccaacgccaatgttatcaggctactggaagaacgatccgttcagcccggaagaggactcacgcttaatcacctcatcatctgctgacggtaaattattagagatcccatttaacccggtgtatcggaattttgacaaaggtcttcaggaaatcaccgactggatcgaaaaacgcttgtgttaaaaatttgctaaattttgccaatttggtaaaacagttgcatcacaacaggagatagcaatgacgttaccgagtggacacccgaagagcagattgatcaaaaaatttaccgcactaggcccgtatattcgtgaaggtaagtgcaaagataatcgattctttttcgattgtctggctgtatgcgtcaacgtgaaaccggcaccggaagtgcgtgaattctggggctggtggatggagctggaagcgcaggaatcccgttttacctacagttaccagtttggtctgttcgataaagcaggcgactggaagagtgttccggtaaaagacactgaagtggttgaacgactggagcacaccctgcgtgagtttcacgagaagctgcgtgaactgctgacgacgctgaatctgaagctggaaccggcggatgattttcgtgacgagccggtgaagttaacggcgtgagtgaaatgtgccggatgcatcacatccggcaatattcattaaaactgatacgtcatgccaaccgcgacaatatcatcattattaatattcaatttgttatcgctatccagttggttgattttataatcaacaaacgctgacatatttttgttgaaataatacgtagcaccgacgtcgatataattgaccagatcttcatcaccgataccttcaatatctttccctttcgataagacataacccagcgatggacgcagaccaaagtcaaactggtattgagcgaccgcttcaaagttctgtgtcttattggcaaagccgccagttattggcgtcattttgcgtgtttcagaatagaaagttgccagataaatattattggcatcgtatttcagacctgttgcccatgcttctgcacgcttgcctgtgccacggctttgcaggttctgctcgttggtgcgatctgagttggtataggccccactaatggcgaaatcgctgccgccaaagtcatatgtcaatgacgtgccgaagccatcgccgttttgctttttaacgtcgcggttttcgtttttcccttgatattgcagggttaagttcaggccatcgataacgccgaagaagtcggtgttccgatacgtcgccagaccgctggcgcgtttggtcataaagttgtcggtctgcgccgaggaatcgccaccaaattccgggaacatatcggtccaggcttccacgtcatacaacgcccccaggttacgaccataatcgaaagaacccaaatctttatatttcaacccggcaaaagcgagacgcgttttttgctgtgcagtatcactctctgctttattaccggcaaactctgcttcccaacgaccataaccagtcagttgatcgttaatttgtgtttcgcctttgaaaccaaaacggatataactctggtcgccatctttactggcgttatcactcatataatgcatggctttaactttgccatagacatccagtttattaccgtctttattatatatttctgcagcctgtacagatgcagatgccacaatgcccatcaccactaatgccagagtgctctttttcattttcattcctgattttaattaacgcgcgaatattcagcgggagagtcccgttgaaaacaggaaagtttttaacctgagattgttaaagatatattacagattaataatattcttaaaatgtggtaatttattaaatctgtaataaaagcgtaaacaactgccgctaggcttgctgatcccgcgcaacaaaacgccatgctttgctcgcagatggttggcaaccgacgacagtcctgctaaaacgttcgtttgatatcatttttcctaaaattgaatggcagagaatcatgagtgacagccagacgctggtggtaaaactcggcaccagtgtgctaacaggcggatcgcgccgtctgaaccgtgcccatatcgttgaacttgttcgccagtgcgcgcagttacatgccgccgggcatcggattgttattgtgacgtcgggcgcgatcgccgccggacgtgagcacctgggttacccggaactgccagcgaccatcgcctcgaaacaactgctggcggcggtagggcagagtcgactgattcaactgtgggaacagctgttttcgatttatggcattcacgtcgggcaaatgctgctgacccgtgctgatatggaagaccgtgaacgcttcctgaacgcccgcgacaccctgcgagcgttgctcgataacaatatcgttccggtaatcaatgagaacgatgctgtcgctacggcagagattaaggtcggcgataacgataacctttctgcgctggcggcgattcttgcgggtgccgataaactgttgctgctgaccgatcaaaaaggtttgtataccgctgacccgcgcagcaatccgcaggcagaactgattaaagatgtttacggcattgatgacgcactgcgcgcgattgccggtgacagcgtttcaggcctcggaactggcggcatgagtaccaaattgcaggccgctgacgtggcttgccgtgcgggtatcgacaccattattgccgcgggcagcaagccgggcgttattggtgatgtgatggaaggcatttccgtcggtacgctgttccatgcccaggcgactccgcttgaaaaccgtaaacgctggattttcggtgcgccgccggcgggtgaaatcacggtagatgaaggggcaactgccgccattctggaacgcggcagctccctgttgccgaaaggcattaaaagcgtgactggcaatttctcgcgtggtgaagtcatccgcatttgcaacctcgaaggccgcgatatcgcccacggcgtcagtcgttacaacagcgatgcattacgccgtattgccggacaccactcgcaagaaattgatgcaatactgggatatgaatacggcccggttgccgttcaccgtgatgacatgattacccgttaaggagcaggctgatgctggaacaaatgggcattgccgcgaagcaagcctcgtataaattagcgcaactctccagccgcgaaaaaaatcgcgtgctggaaaaaatcgccgatgaactggaagcacaaagcgaaatcatcctcaacgctaacgcccaggatgttgctgacgcgcgagccaatggccttagcgaagcgatgcttgaccgtctggcactgacgcccgcacggctgaaaggcattgccgacgatgtacgtcaggtgtgcaacctcgccgatccggtggggcaggtaatcgatggcggcgtactggacagcggcctgcgtcttgagcgtcgtcgcgtaccgctgggggttattggcgtgatttatgaagcgcgcccgaacgtgacggttgatgtcgcttcgctgtgcctgaaaaccggtaatgcggtgatcctgcgcggtggcaaagaaacgtgtcgcactaacgctgcaacggtggcggtgattcaggacgccctgaaatcctgcggcttaccggcgggtgccgtgcaggcgattgataatcctgaccgtgcgctggtcagtgaaatgctgcgtatggataaatacatcgacatgctgatcccgcgtggtggcgctggtttgcataaactgtgccgtgaacagtcgacaatcccggtgatcacaggtggtataggcgtatgccatatttacgttgatgaaagtgtagagatcgctgaagcattaaaagtgatcgtcaacgcgaaaactcagcgtccgagcacatgtaatacggttgaaacgttgctggtgaataaaaacatcgccgatagcttcctgcccgcattaagcaaacaaatggcggaaagcggcgtgacattacacgcagatgcagctgcactggcgcagttgcaggcaggccctgcgaaggtggttgctgttaaagccgaagagtatgacgatgagtttctgtcattagatttgaacgtcaaaatcgtcagcgatcttgacgatgccatcgcccatattcgtgaacacggcacacaacactccgatgcgatcctgacccgcgatatgcgcaacgcccagcgttttgttaacgaagtggattcgtccgctgtttacgttaacgcctctacgcgttttaccgacggcggccagtttggtctgggtgcggaagtggcggtaagcacacaaaaactccacgcgcgtggcccaatggggctggaagcactgaccacttacaagtggatcggcattggtgattacaccattcgtgcgtaaataaaaccgggtgatgcaaaagtagccatttgattcacaaggccattgacgcatcgcccggttagttttaaccttgtccaccgtgattcacgttcgtgaacatgtcctttcagggccgatatagctcagttggtagagcagcgcattcgtaatgcgaaggtcgtaggttcgactcctattatcggcaccattaaaatcaaattgttacgtaagatcttatcattctcccaccaaaaaattatcttaatgtaacagctggtgtaagtaaattctatcaacgaagatcaatcttatctactgaccaaaaaggcctgatagggcttcgctcactatacatccttggctgcaggtttagttgtacaccactcctaaatttaatgtgttggcaatgtgttcaataaagctcgaacaaattagctcattatgatcggttaatacttcaacttctggttgcatgattgtttgtccgtaaaaagataacgcgcctgccgggtagtagcaggcgcattacgcaataggtaaacaagggaggaagttcagaaatgtaaatcgggaaggttgtacgcaatgttcatcgtactacgttgttacggctttgccgcaacaagccagttgcctgccgcgctcgcagaatgtctgcagcccggagataaggagattgttcctgccagctaaatcccttcctgtcgatacgaaccagctcgtatttttctaccagaaaattcacggcatcggctagggtgataccggcatcgatgtgttccttaatcacagcctcattgcagaatggcgtgtcgtttattgtcagaccatagtgctgttccagcagacgtgtcagtaacatttgccagacagccacgggtgacaggcagggcttcaccgcccgctgagttattgcaggtaaagttttcatgtttgctctcgtgtaggtaattaacgctgagtggggtaaatggcgatgtatacgtagccgcaactgccaagggtgtcggcttcgcaggttaaatcgttgtggtacagggtaacgcagtgggcatggtgggggctgagttcaccggtggtcagcatcgattccatctggaggataaagtgcgggaatgtttcatccagcttccggcattcgatgtcactgaacttgccggtgatgctggcccggtcagccagataatgcagtcggttgccttcctgcaccagacgggctcccaggcgcagtgtaatctcccgctgcaggcccctggtagggttgctcattacagttctccactattgtcagttcagggtgatgctcatcaggcaggtatagggcccattgcggtcctggcggcgttcggcgtataccgcgaggactccggcgatatccggaacgtccctgccggtgtaatgacagacgctaccgtgccactggtatttgccggtgcagtagcgaaagattcgggactcaggatgctggcggtatatcgtcattgccctgcgtttactgataattttcatgtaatacctcaaagcagaccgtgttctgcgaacgaatagatttgcctgccaccgacaatcagatggtcagggacacggatatccaccagctgaagcacctgaaccagtcgctgcgtgagggttttgtcggcctggctaggtgtcgtctcgccggaaggatggttatgcgcgagtatcaccgccgccgcgttgaagtgcagagcacgtttgaccacctcccggggatgcacctcggtgcggttaatcgtgccggtgaagagcgtttcatgggcaatcaactgattctggttgtccagatacaacacccggaactcttcccgctcaagcgcggccatatgcagtcgcagccattcacgtacggcgtgggtagaggtgaaggctacgccgggctcatgcaggtggcggtccagagccctgagcgcccgctgaatgagacgccggtcctgtggcgtcatctcgccgggtaaaaaggaaagctgtttcatctgttgctccttcggtcagtcgataatacgcagaatggcgtgagcctctggatgttgcatggcatactcccgcaggcggtaatagtgtgcggtcatcgcgtcacattctgtacggcaggcatggtggctatacgcaatcaggcagacagcaatacctgctgcttctgcactcatttgggcatcgttaccgttcaggcagttaaacagacgccatgtctcatcgttgtcaggctcgggggacataaatgcgccgccattgctgagggtgtagaacgaccagataccaccgctgtagccctcacagaagcggtccatccaggcgaagatatgcggctccaggagtagccactgcgggatagcgccaaagtactgtggccagaaatcgatacgctgttcatcggggaccggcgtgacggtcagttcaaattcgggttggttagcgggtgcgaggtcgtgctgcgtctgtgttgtcatgggtatgtctccgtcaataaaaacgccagcggcgatggctggcgtatggggatataaagtgtgttcggggaggtgaatgcgggtaaatgcttcgcgatcagcgggtggccgtgtctgtacggatgcctgaggtgcggatatagcggttaagaccttcaccggcatccggctcaaagttccatgcccgccagaccatccggccttcagtatcacgaaccaccagacggaagtgactgccctggtcgtcttcgagtgtgatattgctgtacgtggtagtgaccgcttgcgcttgtctccgggtgaaaggccccggtggcagcaacacggattgggtcattttcgggctcctgataaaagaaaaccccggcagcctgctagctgtcggggtgaatttgctggggaagatactactatcagtcgttgctgcagtctccgagagtggacagaactttctcagcgttcttccggtccgcagtgaaggtccctgctttgtggtcattgacgtagacgtcgaactgcccggcctcagagatattgctgatgaagtcaaaccaggcgttatcgccgttacgccagcccaggctggacggaataatgtactgctggtgatccatcactacggtgatagtagtgtcgtcatcgtgcgaactgaccatcttgtcatcggcaagggtaagaaagactgaatgctgatagaaaccattctggtccgggttccctgtgcagttgatggtaaacgtctttccgctggcttcggtcacgctgtattccgtattgccctgaccgtaaccctgctgccagaaccccgggatagcagaggcattaaagctcgcgagcagtacacccgccagcataaaccgacttagtgaaagtattgtcattcttgtctcctttgtcgttgttttattcctgattgtcagggttcgagggtatcagtagctgccccatcagtttgccgtcatgggcgtactcaaagtatttttctttggtatacgggtccgtcacctcctggtattccagtttgatgttatcggcaatacacagcgcattcatcagtggctggacggttttttcctgcatatccacgaggtagtagtaactgccatcctcgcagccatcgggcgactggcgggtacgtaaaacctgcaaggtgggaccggataagtagtcaacctgtgaccattcttcgctgacatcatcctggtggctgaccacatcactgaaacgcggtggggtgaggtccttaaatttactgatggccttcaggtcatcacttctgtcatcgcatgcgatgagaaacagagtggtggcaaccagcgccagcagaggcagtgttttacgtttcattatttttttcctgaaatcagacgaaccactttggcaaagacataaatgcccacgaaaatacccaccggcacgccgacgaacggtgtcagcgcgacactggcagcaccggctgcgccacctcccgtcagcagtgcggcaacagtggcaagggtcagggccgcgagactgtcggacaccccggttttgttcagaatgatgacgatgacaacaatggcgataatggcaatatccggactgatactccaggtccagatacatcagccgctcacgaaaatcacgccgcagcgtgcgcaccgacacaccaaactcagcggcaagcttacgcacactcagcgtttcccctgccaccagacggctgattatcagtgacagcctgacagccagccggtcatggcggcgttctgcctgtgtcatgagacgttctccgtgaaagttaactgactgaaaatgatgtgattactttaaagagggggtcggacagggtatggacaccacagaaactatttttcatttctgcaaaagccagaggcagcgggggttacaggccttccctcggtgagtgaggaccgtcagcacggtgcgatgcggacaggtggtgtccgatattaacaaagcagcaacattaaacggtcactgcagttgcgtgagcagggcttccgccatcacccacagtgcccggttaagtttcacgtccccgtcgataccgcgaacggcacgggtatgtgaccgtcctcctttggcattacggccactgagcccgcccttaatcaggttctcctgaatacgctggtacgtggtccacaggtcattgctctcatcctgccagcggcgaggggagaggatctgcgattcagtcaccggctggtggtcttcaccaaagcggtatgtgagggcggcttttgccagtgcctgctgtgccgggggtggcaacagcaacgactgcatggcatcccgtttctcctccacccggtcaaaaatccccagcacctcatacgcgccttcaatcacctgactcaccacgtcccccttgtgtggcacccgcacctcgccaaacgactcaccgcagacgagcccgttctgacaaaccgcacgaaatagtcccggcaacatctgatacgaactggttccatcgtgagagttgagtagaataatttccggcacctgtttaccggtgatctgcccttcccgccgcagacgcagcatatgctttgtatgttcacgacgacccgggtcacgcacgcgggtctgacaggcaaagaatggctggaagccttctcgctgtaggctgtcgagcagggagatggtgggtatataggtataacgctcactacgggactcgtgtttgtcctcactgaatacactgggcactacgcgaaacagctcttcacgggttaacggacggtcgcgacggataaggtttgctgcgccaaagcgcgaagccagacgggtcataagcagactcctcataacgggaaaacaaataaaagggatccccgtcgcatcggcgacaggggcagggaagtaacagggatgggttaaatactcagaagaagaaatcccagacggcgcgggccactgacaccaccgtggtgcgcacggcctgaatgacggcccgcaccggggcgggtatcaggggaaaggcactgatgctatcgagtacggccccgacggtttcaccaaaatcgctacgagcctgttcccggactaccgtcgtgcgaaaggaaggatggagttgcgacaccaccgggctggtggcctcacgtggcaggcacttaatcatccgctcggccatcaccttaagcccccattgtagacggaccgacacagcacacaccggatggacgggctggaacagctcatgcagcaggcagattttgcggctgatattctgcttctgcgccgtggacaactgtcccccaccgctggtaggttcggccttatccgactggctgataacaaacagcaccttatgccggtatacctctccaatcacctgatgataaaaatgttcatccaccgtcagcgcccggtcatcggccttaatcagccacagtaccaggtcgaggcgaggaagctgttcgcggtacagcgcagcatactcggtatcgcgagcgccactttcgcccacgccgggcagatccatcagcgttatatagcggtcgccgacttgcaggcgaaagcgcagtggctcacgtgtacaggccgccacatcgctgaccggtgatatatctccggcaaacagggcattgcacagactgctcttcccaacaccggttttacccataatgccgatcactggctcgtagttagttaactggttaatttgctgcagaagccgctctgatacccattgcggcagatcagcaagcgattgctgaaacgacttcaaaccttcagaattattcatcactactcctctgaaaaataataaaaaacggtagaatcgtgagattccgccgttaattgcgtatgttcagagtgatgatatatatctgaagattttttcaatcctctgcgcttgaggcagctgcgcgactgctggctcaggcaatgaatgagttataatagcagcatttactaacagggatttattgagagtatgagccgccgtgatacaccttaaaatctcaacccagcaaagtttcggagccgcgagcaaaagtgagagccttcacaaaataatgcttagtaataaagttactttgaattcagagccccgattaatgtgaacatgatcaacgaattttacccagattgagttcattcagtagccaggttttgaacacatcaagcgcagaatgcatgtgttggtgctgggggaaaaccaaataatgaccgatgtaatgtatttcgctggtactgtttacaagtgggcataccagtttaccgctagcgatttcacgttcagccagtagttttgattcaagcacaactcccaagccgtcaactgcggcagcaatcgccataaagctacggtcaaatcgaaggccataattattgggtggcgtcatcttattcgcctcaaaccatcctttccactggtacaactgcacatcgcactgaatcaatgtcaacgcatagagatcctctggtttctttagccgctcagccagttggggagaacacagtggcgtaagttcttcaacagcaagcgggatcttctcatagggtgatgggcggggttcaccgtagactatatcgagatcaaaatcatcctgttcaaaacgtgcatattctgtgctggctgaaagtcgcagatcgatgcttgggttctcacgtatgaacttaccaagacgtggtaaaagccattgatgggcaaaactcggtgcagtatgaaggcgcaaaggcctggattcatcagccgtcactaatgccaacccctgctgtaattcgttaaatccccgctgtatgtgctcaagcagtatttcaccttctttcgtcagcgtaatttctcgcgtactgcgctgaaaaaggcgtacatcaagcaagttttccagtttgcggatggcatggctgatcgcactgggtgacagttccaactcagaggcggccaacgcaaaagctccggtacgaccagccgcttcaaaggcgcgtaacagatttagaggtgcttttgctaagagcttcattcatgaatccttttcactagggatgaagtggtttactgaatttggccacctgaacagaggtgatatgctcacctcagaacaacacaggtgtcataatgaaaaaaagaaatttcagcgcagagtttaaacgcgaatccgctcaactggtcgttgaccagaactacaccgtggcagatgcagccagcgctatggatgtcggcctttccacaatgacgcgatgggtgaaacaattacgtgatgaacggcagggcaaaacaccaaaagcctcccccattaccccggaacaaattgaaatccgtgagctcaggaaaaagctacaacgtattgaaatggaaaatgaaatattaaaaaaggctactgtagattcaattggtcaacgcaacagttatgtgaaaacatggggttgcggaggttttttgaatgagacgaacatttacagcagaggaaaaagcctctgtttttgaactatggaagaacggaacaggcttcagtgaaatagcgaatatcctgggttcaaaacccggaacgatcttcactatgttaagggatactggcggcataaaaccccatgagcgtaagcgggctgtagctcacctgacactgtctgagcgcgaggagatacgagctggtttgtcagccaaaatgagcattcgtgcgatagctactgcgctgaatcgcagtccttcgacgatctcacgtgaagttcagcgtaatcggggcagacgctattacaaagctgttgatgctaataaccgagccaacagaatggcgaaaaggccaaaaccgtgcttactggatcaaaatttaccattgcgaaagcttgttctggaaaagctggagatgaaatggtctccagagcaaatatcaggatggttaaggcgaacaaaaccacgtcaaaaaacgctgcgaatatcacctgagacaatttataaaacgctgtactttcgtagccgtgaagcgctacaccacctgaatatacagcatctgcgacggtcgcatagccttcgccatggcaggcgtcatacccgcaaaggcgaaagaggtacgattaacatagtgaacggaacaccaattcacgaacgttcccgaaatatcgataacagacgctctctggggcattgggagggcgatttagtctcaggtacaaaaaactctcatatagccacacttgtagaccgaaaatcacgttatacgatcatcgttagactcaggggcaaagattctgtctcagtaaatcaggctcttaccgacaaattcctgagtttaccgtcagaactcagaaaatcactgacatgggacagaggaatggaactggccagacatctagaatttactgtcagcaccggcgttaaagtttacttctgcgatcctcagagtccttggcagcggggaacaaatgagaatacaaatgggctaattcggcagtactttcctaaaaagacatgtcttgcccaatatactcaacatgaactagatctggttgctgctcagctaaacaacagaccgagaaagacactgaagttcaaaacaccgaaagagataattgaaaggggtgttgcattgacagattgaatctacaaccgcgctcttgatgtcagactccctgaacagttctcgataatcgggaaactcagggcgcgttatcctgtggccactctctgccatgtgttcggggttcatcgcagcagctacaaatactggaaaaaccgtcctgaaaagccagacggcagacgggctgtattacgcagtcaggtacttgaactgcatggcatcagccacggctctgccggagcaagaagcatcgccacaatggcaacccagagaggataccagatggggcgctggcttgctggcagactcatgaaagagctggggctggtcagttgccagcagccgactcaccggtataagcgtggcggtcatgagcacgttgctatcccgaatcatcttgagcgacagttcgccgtaacggaaccaaatcaggtgtggtgcggtgatgtgacctatagtgtgcccggagttcagggcgggcatggatgcttaaatgaaccgcgagtctgtctggaatattgaaccggtaactcacgatgagaaacccaacaatcccaccgggtgtgacggtggagaacctgagcggcagtgacctgcggcatgcccgcagggtgatgtaacccgctgacaacggggattgaggcgagatcactaagccgagatgatcctcaaggttaagtactgaaaggttgaagaacatgaacccgttaatccgcctctgtgggttgaaaacgtcaccacggcctacgtgatctgacaggccgtgcaggaggaactggcagtgatacgtaagcactgccggtcgaaggtgttttgacatgtatgcgaaacaccggggcagcagcgtctatcacgcttgcgttgctgacttctgccaacttgcggcaagcaaggataaagagtgcgacgggcagcctcctcagtatgcctgagtccaggcaggtaaaccggggaaggtcagcgacggatgttaagggggcatggctccgatgacgcgctggctggcggagcttccgtagtagtccgcgatggggaaagcccattacatggcgaagggaagcagtttgaatgtgtttgcgacgtgaattaactgacctaacgaggtgaagacctttgataatcagcgaaatgcaacgcaagcttgccacatgggcagccaccgatccgtccctacggattcaacggctgctgcgtctgataacacaaccagaatggctggctgaagcggcgcggatcacgctttcatcaaagggggcccatacccccggcgttgatggcgtgaacaaaacaatgctacaggccagactggctgttgagctgcaaatcctcagggatgaattactctcaggccactaccagcccttgcccgccagacgggtttacatccctaaaagcaacggcaaactgcgaccactgggtatccccgcgttgcgggatcgtattgttcagcgggccatgctgatggcgatggagccgatatgggagagtgattttcatacgctctcatatggcttccggcctgagcgcagtgtccaccacgcgatccgcacggtgaaattacagctcacagactgtggtgaaacccggggacgctgggtgattgaaggcgacctgtccagttacttcgacaccgtacatcatcgactgctgatgaaggctgtacgccgcaggatcagtgacgcacgtttcatgactctgctgtggaaaaccatcaaggcgggacatatcgatgtcggtctctttcgggcggccagtgaaggtgtgccacagggcggtgttatatcgccgctattatcgaacatcatgctgaatgagttcgatcaatacctgcatgagcgctacctgagcgggaaagccagaaaagatcggtggtactggaataacagtatccaacggggccgaagtacggcggtcagagaaaactggcagtggaaacccgcggtggcgtactgccgctatgccgatgattttgtcctcatcgtcaaaggcaccaaagcacaggtggaagccatcagggaggagtgtcggggtgtgctcgaaggcagtctgaaactcaggctgaacatggataagactaaaatcccccatgttaatgacggctttatctttctggggcacaggctcattcgcaaacgcagtcgttatggcgagatgcgagtggtctcaacgatcccgcaggagaaagccagaaacttcgccgcatcgctgacagcactgttatggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccggaggcgttatgagctggcggccctttttgtatctgattattaatccccacccgctattaagcgcccggcgcgggcatctgcgtctggtgcagggttgactttgcattctgttaacaaacgcggtataacaaaccttctttggatgtttagatgtccatacgtttagaaggttatatgcaaacaacacaacaaaatgcgccactgaagcgcacaatgaaaacgcgtcacctgattatgctttccttgggcggcgtgattggcacaggattattcttcaataccgggtacatcatttccaccactggagcggcgggaacgctgctggcctatctgattggtgcgctggtggtctggctggttatgcagtgtctgggcgagctgtcggtcgcgatgccggagaccggagcgtttcacgtttatgccgcgcgctatcttggtccggctaccgggtataccgtggcctggctttactggctgacctggaccgtggcgctgggttcgagctttaccgccgctggattctgtatgcagtactggtttccacaggtgccggtatgggtctggtgcgtggtgttctgcgcgattatttttggtctgaatgttatctccacgcgcttttttgccgaaggggagttctggttctcgctggtcaaagtggtcactatcatcgcctttatcatcctcggtggggcggcgattttcggctttattccgatgcaggatggctcgcccgcgccggggctgagtaatatcacggcagaaggctggttcccgcacggtggcttaccgattttgatgactatggtggcagtgaactttgctttttcgggtaccgagcttatcggcattgccgccggtgaaacggaaaacccgcgcaaagttatcccggtagcgattcgtactaccatcgcgcgactgattattttctttatcggcaccgtgtttgtgctggcagcgctgatcccgatgcagcaggtgggcgtggagaaaagcccgtttgtgctggtatttgagaaagtagggatcccgtacgccgctgatatttttaacttcgtgatcctgacggctattctttctgcagcgaactccgggttatatgcctccgggcgcatgctgtggtcgttgtcgaatgaacgtacgctaccggcctgttttgcgcgagtaacgaaaaacggcgtgccactgacggcgctgtcggtcagtatgctcggtggtgtgctggcgctgttttccagcgtggtggccccggacacggtatttgttgcgctgtcggcaatctccgggtttgcggtggtagcggtgtggctgagtatctgcgcctcgcattttgtttttcgtcgccgtcatctgcaacaaggtaaggcattgagtgaattacattatcgcgcgccgtggtatccgctggtgccagtattaggttttgtgctgtgcctggtggcctgtgttgggctggcattcgatccagcgcagagaattgcgttgtggtgcgggttaccgtttgttgcgttgtgctatggtgcttatttccttactcaaccccgaaacgcaaaacaggagccagaacatgtcgcagaataatccgttacgcgctcttcttgataaacaggatatcctgctgctggatggcgcgatggcgacggagctggaagcgcgagggtgtaacttagccgacagcctgtggtcagccaaagtgctggtagaaaacccggagcttatccgcgaagtgcatcttgattactaccgggcgggggcgcaatgcgcgatcactgccagctatcaggcgacgccggcgggcttcgccgcgcgaggtctggatgaagcgcagtcgaaagcgctgattggcaaaagcgtggagctggcgcgtaaagcccgtgaagcgtatctggcagagaacccgcaggcgggaacgcttctggtggcgggatccgtcgggccttacggcgcgtatctggcggatggctctgaataccgtggcgattatcattgtagcgttgaggcatttcaggcgtttcatcgcccgcgcgtggaagccttgctggatgccggggccgatctgctggcctgcgaaaccctgccgaatttttccgagattgaggcgttggccgagctgttgaccgcatatccgcgtgcgcgggcgtggttctcatttaccctgcgcgacagcgaacacctgagcgacggtacgccgctgcgtgacgtggttgcgttgctggcgggttatccgcaggtggtggcgctaggcattaactgtattgcgctggaaaacaccaccgctgcgttgcagcatttacacggtttaacggtgctgccgctggtggtgtatccgaactcgggcgagcattacgatgccgtgagcaaaacctggcatcatcacggtgaacattgcgcgcagctggcggattatctgccgcagtggcaggccgctggcgcacggttgattggcgggtgctgtcgcaccacgcctgcggatatcgccgcgttaaaagcgcgaagctgagggtttatcgggtctacatcgttcattgtaggcctgataagcgcagcgcatcaggcattgccggatggcggcacaagcgccttatccggcctacaaaaccacaaaacgttatgccgcatccgccagaacaaacatgccgtacggatggatttcaagataatactgctcgccgacgtccggttgcagacgcgtagcgttgacctgcaataatatctcctgcccgtgccattccaccgtcacttcatactgcggccccatataggcgacatggcggatcacgcagcgctggctctcttcgccgcgatcgctgagcgtgatcgcttccgggcgcacaccgaccatcccttcaccctgtgtaccaaagtgcagcgggcgcggcagatgatagccgtagatatcaacgtatccgtcgctgaaggttgccgggaacaggttggcatcgcccataaagctcgccataaagcgggaggcgggctggcggtaaagatcctgcggtgagccgatctgcatgatgtgtcccttgttcatcaccagcacagtatcagaaaccgcaaaggcttcgctctgatcgtgggtgacgtacagcgaggtgatatcaaactgcttttgcaactcgcggatcttgtcgcgcatgctgcgacgcaggttggcgtcgaggttactcaacggctcatcaaacagcagcactttcggcttgaggatcagcgcgcgggccagcgccacgcgctgctgctgcccgccggagatctgatcgacaaagcggtcttcgaatccttccagatccaccatcgccaacgcctctttgacgcgggctttcagctctgcgcgcggtacgccgagcattttcaggccataaccgacattctctcccagcgacatatgcgggaacagggcataggactgaaacaccatacagatatcgcgctgctgaatagagcgatgggtgacgtcttcgccatcaatgaaaatttgcccttcgctcggtttttccagcccggcaaccaggcgcaaaatagtggttttgccgcagccggacgggccgagcagcgtcaccatttgcccctgcgggatggtgaggttgatattgtcgattaccgtattactgccaaatcgtttagtgacgttgcgcagttcaacgaaatttttctgagtcatagtgcgctccattacgcctggtttttggcttttgaacgggaggtacgtgattcaccgatcagccagtcaaagatgaaaataatcgccagcatcaccacgatcagaatggaaccgtaggcaatcgctacaccgtattcgccatcttccacgcggttgaggatgtaagccgtcgctacgcgggtatccggcgtgacgaggaacacaatggcgctgacggtggtaatggcgcgcacaaagctgtaaatcagcgccgagaggatcgccgggcgcagcagcggcagcaggatgtgcgtaatggtacgcagggaaccggcgcgcaggctgagtgaggcttcatcgagcgatttatcgatttggcccggtaatgactccaacttattgatagtgttttatgttcagataatgcccgatgactttgtcatgctgctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagcctgtcatacgcgtaaaacagccagcgctggcgcgatttagccccgacgtatccccactgttcgtccatttccgcgcagacgatgacgtcactgcccggctgtatgcgcgaggttaccgactgcggcctgagttttttaaatggcggaaaatcgtgttgaggccaacgcccataatgcgggcggttgcccggcatccaacgccattcatggccatatcaatgattttctggtgcgtaccgggttgagaagcggtgtaagtgaactgcagttgccatgttttacggcagtgagagcagagatagcgctgatgtccggcagtgcttttgccgttacgcaccaccccgtcagtagctgaacaggagggacagctgatagaaacagaagccactggagcacctcaaaaacaccatcatacactaaatcagtaagttggcagcatcaccgagaacacaaatgggctaattcggcagtactttcctaaaaagacatgtcttgcccaatatactcaacatgaactagatctggttgctgctcagctaaacaacagaccgagaaagacactgaagttcaaaacaccgaaagagataattgaaaggggtgttgcattgacagattgaatctacagcagctttttttaatatgtcccgttcgtcggtaacccgtttcagctctttctggagacggcggatctcggcctgagcatctgactgttctttattagtggaagaatccggaccgtacttctttatccaggcataaaggctgtgggtggtgatatcgagacgtgttgcaacgctggcaacagaataaccgagatcaacaacctgtttgactgcttcagttttaaactcttcgggataacgcttaccgctcatgggcacctctctttaagccattttaaatgactcggaggtgtctgttaaacccgtggcgattcaaaattgcgatatatacatacccatgactgcccagcgtatcggcttcaccagtcagcccgttacggtacagtgtgacacagtgcgcgtacctgggattcagctcacaggagagcagcatcagctccagatgtgcgacaaaatgcgggaaggcttcatccagttgtagagtctgcacctcactgaatgagccggtgaatccagcccggtcagccagaaaatgcagacgatgaccttcctgcaccagtcgtgctccgaaacacggtgtgatatctcgtttaagcccccaagtttgagtagagtctttattcataattttattcctgttaaagaagaccatgttcggcgaatgagaatatttgcctgccgccgacaatcaggtggtcggggacatggtgaacactttttaacatcctttacccatggtgatcgactttttcttcaggtcgatcacccccactttcgtgctgtaccaccacacctcgtagctgccgtcttcctgcatctccttcagcccgacccgttctcccctgaacgccttgcctgcgctcagacttacccctttcacgctcagctttccgctgatatccactttcctgaccatcaccccttcatcgtattccgggggcgttgtgttgccgctgtactgccgcgctgacggctgataccgcgagcccggtaccgccatatccagcgcctcgtgcgggcgttcaaggttatagaccgtccgccagtggtcgaaggcgcgctgcagttcaccgctgtctgcgaaccattttccctgcagcacttccgccttcaggctgcggtgaaaacgctccagcttcccctgcgtctgcggatgataaggccgggagtgccccacccggatacccaggcgcatcagccacagctccagcgccgtccaggtgccggtggtgtcgccccacggtgagccgttatccatggtcatccggtccggcaggccgtaacgctcaaacacgctgaccagctgctgctgcacggtctcgcgccgttcatcggtacagtgcgccaggcacagggaaaaacgggagtggtcgtccagcagggtgagcggatggcagcgtccaccgccaaaaggaaagtggcccttaaaatccatctgccagaggcggttcggcgcgtcgtgttcgaaccggcccgtggcgggaatgcccggtgaagcgcccggcagcaggccatggcgggccatcaggttatggacggtgctgaaggcgggcatggtgtgcccctggtcctcgagccagcgcttaatcttgcgggctccccagcgttcatgacggtcatgggccatacgcagcagggccgtgatgtcgtcagatgagcggttcggggaatggtgcggaatgcgcgggcggtcctgaagaccggcggcaccttcctgagcccagcgctggagccacttgtagccggtggcaggtgaaatgccgaagcgacggcagagggaacggatgttcgccccgtcctgcgaggcgaacaaaacaaactcagtacgtaatgacatggtatctctcgcatcccagggcataagcgactccataaacgggttcttatgccttagttgtaagtgtctaccatgtccccgaacaagtgttcactatgtccccggaccgtacaccccaaaggggagaggggactgcaccgagccatcttttccccctcgcccctttggggagagggccggggtgaggggcaatatgtgatccagcttaaatttcccgcactccctcttcccttccgatttacctctccttgttctgcgtcatagtatgatcgttaaataaacgaacgctgttctataatgtagaacaaaatgattcagcaaggagatctcatgccgcagtccgcgttgttcacgggaatcattccccctgtctccaccatttttaccgccgacggccagctcgataagccgggcaccgccgcgctgatcgacgatctgatcaaagcaggcgttgacggcctgttcttcctgggcagcggtggcgagttctcccagctcggcgccgaagagcgtaaagccattgcccgctttgctatcgatcatgtcgatcgtcgcgtgccggtgctgatcggcaccggcggcaccaacgcccgggaaaccatcgaactcagccagcacgcgcagcaggcgggcgcggacggcatcgtggtgatcaacccctactactggaaagtgtcggaagcgaacctgatccgctatttcgagcaggtggccgacagcgtcacgctgccggtgatgctctataacttcccggcgctgaccgggcaggatctgactccggcgctggtgaaaaccctcgccgactcgcgcagcaatattatcggcatcaaagacaccatcgactccgtcgcccacctgcgcagcatgatccataccgtcaaaggtgcccatccgcacttcaccgtgctctgcggctacgacgatcatctgttcaataccctgctgctcggcggcgacggggcgatatcggcgagcggcaactttgccccgcaggtgtcggtgaatcttctgaaagcctggcgcgacggggacgtggcgaaagcggccgggtatcatcagaccttgctgcaaattccgcagatgtatcagctggatacgccgtttgtgaacgtgattaaagaggcgatcgtgctctgcggtcgtcctgtctccacgcacgtgctgccgcccgcctcgccgctggacgagccgcgcaaggcgcagctgaaaaccctgctgcaacagctcaagctttgctgagccggacgataacgatgaccattgagaaaattttcaccccgcaggacgacgcgttttatgcggtgatcacccacgcggcggggccgcagggcgctctgccgctgaccccgcagatgctgatggaatctcccagcggcaacctgttcggcatgacgcagaacgccgggatgggctgggacgccaacaagctcaccggcaaagaggtgctgattatcggcactcagggcggcatccgcgccggagacggacgcccaatcgcgctgggctaccacaccgggcattgggagatcggcatgcagatgcaggcggcggcgaaggagatcacccgcaatggcgggatcccgttcgcggccttcgtcagcgatccgtgcgacgggcgctcgcagggcacgcacggtatgttcgattccctgccgtaccgcaacgacgcggcgatcgtgtttcgccgcctgatccgctccctgccgacgcggcgggcggtgatcggcgtagcgacctgcgataaagggctgcccgccaccatgattgcgctggccgcgatgcacgacctgccgactattctggtgccgggcggggcgacgctgccgccgaccgtcggggaagacgcgggcaaggtgcagaccatcggcgcgcgtttcgccaaccacgaactctccctgcaggaggccgccgaactgggctgtcgcgcctgcgcctcgccgggcggcgggtgtcagttcctcggcacggcgggcacctcgcaggtggtcgcggaggcgctgggtctggcgctgccgcactccgcgctggcgccgtccgggcaggcggtgtggctggagatcgcccgccagtcggcgcgcgcggtcagcgagctggatagccgcggcatcaccacgcgggatatcctctccgataaagccatcgaaaacgcgatggtgatccacgcggcgttcggcggctccaccaatttactgctgcacattccggccatcgcccacgcggcgggctgcacgatcccggacgttgagcactggacgcgcatcaaccgtaaagtgccgcgtctggtgagcgtgctgcccaacggcccggactatcacccgaccgtgcgcgccttcctcgcgggcggcgtgccggaggtgatgctccacctgcgcgacctcggcctgctgcatctggacgccatgaccgtgaccggccagacggtgggcgagaaccttgaatggtggcaggcgtccgagcgccgggcgcgcttccgccagtgcctgcgcgagcaggacggcgtagagccggatgacgtgatcctgccgccggagaaggcaaaagcgaaagggctgacctcgacggtctgcttcccgacgggcaacatcgctccggaaggttcggtgatcaaggccacggcgatcgacccgtcggtggtgggcgaagatggcgtataccaccacaccggccgggtgcgggtgtttgtctcggaagcgcaggcgatcaaggcgatcaagcgggaagagattgtgcagggcgatatcatggtggtgatcggcggcgggccgtccggcaccggcatggaagagacctaccagctcacctccgcgctaaagcatatctcgtggggcaagacggtgtcgctcatcaccgatgcgcgcttctcgggcgtgtcgacgggcgcctgcttcggccacgtgtcgccggaggcgctggcgggcgggccgattggcaagctgcgcgataacgacatcatcgagattgccgtggatcgtctgacgttaactggcagcgtgaacttcatcggcaccgcggacaacccgctgacgccggaagagggcgcgcgcgagctggcgcggcggcagacgcacccggacctgcacgcccacgactttttgccggacgacacccggctgtgggcggcactgcagtcggtgagcggcggcacctggaaaggctgtatttatgacaccgataaaattatcgaggtaattaacgccggtaaaaaagcgctcggaatttaattattttaagagataaaaccgtctgcggaatatttcccgcagacggctttgttgtttttgaaatttattaatttaaacaattagttgagatatatcgttggcgtcacaaaagcaaaataacgtaattcggaaataagatatgaccattgctggttaattgaatagctcattacactccattaacacgatgttgtaattcggcacactacataagggtgtaattctgatgacgcaattaaccatgaaagacaaaattggctacgggctgggagacaccgcctgcggcttcgtctggcaggccacgatgttcctgctggcctatttctacaccgacgtcttcggcctgtcggcggggattatgggcacgctgtttttggtctcccgcgtgctcgacgccgtcaccgacccgctgatggggctgctggtagaccgcacccgcacgcggcacggccagttccgcccgttcctgctgtggggggccatcccgttcggcatcgtctgcgtgctgaccttctacacgccggacttctccgcacagggcaagatcatctacgcctgcgtgacctacattctcctgaccctggtctacaccttcgttaacgtgccgtactgcgccatgccgggcgtcatcaccgccgacccgaaagagcgtcacgccctgcagtcctggcgcttcttcctggcggcggcgggctcgctcgctatcagcggcatcgcgctgccgctggtgagcatcatcggcaaaggggacgagcaggtgggctacttcggcgccatgtgcgtgctggggctgagcggcgtggtgctgctctacgtctgcttcttcacgaccaaagagcgctacacctttgaggtgcagccgggctcgtcggtggcgaaagaccttaagctgctgctgggcaacagccagtggcgcatcatgtgcgcgttcaagatgatggcgacctgctccaacgtggtgcgcggcggggcgacgctctacttcgtgaaatacgtgatggatcacccggagttggcgacccagtttttactttacggcagcctcgccaccatgttcggctcgctttgctcctcacgcctgctgggccgcttcgaccgcgtcaccgccttcaagtggatcatcgtcgcctactcgctgatcagcctgctgattttcgtcaccccggcggagcacatcgcgctcatttttgccctcaacatcctgttcctgttcgtctttaataccaccacgccgctgcagtggctgatggcttctgacgtggtggactacgaggagagccgcagcggtcgccgcctcgacgggctggtgttctccacctacctgttcagcctgaagattggcctggcgattggcggggcggtggtgggctggatcctggcgtacgtcaactattccgccagcagcagcgtgcagccggttgaggtgctcaccaccatcaaaattctgttctgcgtggtgccggtggtgctctacgcgggcatgttcatcatgctgtcgctctacaagctcaccgatgcccgcgtggaggccatcagccggcagctgattaagcaccgcgcggcgcagggcgaggccgttcccgacgccgcgacagccgcatcccattaaccggaggcaatatggaaatcactaacccgatactcaccggcttcaacccggacccgtccctgtgccgccagggcgaggactactacatcgccacctcgaccttcgagtggttcccgggcgtgcgcatctaccactcccgtgacctgaaaaactggtcgctggtcagcaccccgttggaccgcgtgtcgatgctggacatgaagggcaacccggactccggcggcatctgggcgccgtgcctgagctacgccgacggtaaattctggctgctctacaccgacgtgaagattgtcgactcgccgtggaaaaacggccgcaacttcctcgtcaccgcgccctccatcgaggggccatggagcgagccaatcccgatgggcaacggcgggtttgacccgtccctgttccacgacgacgatggccgcaaatactatatctaccgcccgtgggggccgcgccaccacagcaacccgcacaacaccatcgtgttacaggcgtttgacccgcagaccggcacgctctcgcccgagcgcaaaacgctgtttaccggcacgccgctctgctacaccgaaggcgcgcacctgtatcgccacgcgggatggtactacctgatggccgccgagggcggcaccagctacgagcacgccgtcgtggtgctgcgttccaaaaatatcgacgggccgtacgagctgcacccggacgtaacgatgatgaccagctggcacctgccggagaacccgctgcagaagagcggccacggctcgctgctgcagacgcatacgggtgaatggtacatggcctacctcaccagccgcccgctgcgcctgcccggcgtgccgctgctggcctccggcggacgcggctactgcccgctggggcgcgagaccggcatcgcccgcattgaatggcgcgacggctggccgtacgtggaaggcggcaagcacgcgcagctgaccgtgaaaggcccgcaagtagccgagcagcctgcagccgttccgggcaactggcgggacgatttcgacgccagttcgcttgacccggagctgcagaccctgcgcattccgttcgacgacaccctcggctcgctcaccgcgcgcccgggcttcttacggctctatggcaacgactcgctcaattcgaccttcacccaatcgaccgtggcgcgccgctggcagcacttcgccttccgggcagaaacgcggatggagttctcgccggtgcacttccagcagagcgcggggctgacctgctactacaacagcaaaaactggagctactgctttgtggactacgaggagggacagggtagaaccatcaaagttatccagctcgaccacaacgtgccgtcgtggccgctgcacgagcagcccattccggtgccggaacatgcggagagcgtctggctgcgggtggacgtggatacgctggtctaccgctacagctactcgtttgatggcgagacgtggcacaccgtgccggtgacgtatgaggcgtggaagctgtcggacgactacatcggcgggcgcggcttcttcaccggcgcgtttgtgggcctgcactgcgaggacatcagcggcgacggctgctacgcggacttcgactacttcacctacgagccggtctaacggctcaggccgggtagcccagcgcgcgcgagagcgcgagcccggcctgctgaagctgctcgcggaaattagccagctccgcgtcgtccacgcgggaggtcagcgtcgacaggctcagggcggcgatgacgcgggactcgtggttccacaccggcaccgccacgcagcgcacgccctgctcgttctcttcgctgtccagggcgtagccttgctcgcgggtctgcgccagggcgctcattaaggcttcgcgagacgcgagggtggcgggcgtaaaggtagtgtactgatagccctccagcagggcgttcagctcggcctcgcccagccaggcaatcaacaccttgccgatggcggtggcgtgcaccggcaggcggcggccgatgcgtgaataggcgatggcggccagcttgccttcaatcttctcgatatagaccccttcacgcccgtccaggatccccagatgggtggtctgcccggtccgccgggacagctccgtcagccagccttttgccttctgccgaatatcgatggagcccacgacaaaatggccgcgctcgaccagcttcatgccgaggcgatacttgccgttctccgggttctgatcgatatagccgtgaagctgcagggtttttagcagcgagtggagggtactcttgctcagccccatcagtttgctgatgtcggtgatcttaagctcggtggcctgctcgttgaacaggtcgaggatctgcaacgcacgttcaacagactgaataatcggcataatgctggcatgtccacgctggaattaaggcgaaaacgtacctttttcgggatgaaaaatcaatgaaatggagccggtgttctccctctccctgtgggagagggccggggtgagggcaccaacgcgcagcggacccaatcactccccaagcgttgccatcatcaccgccttaatcgtatgcatccggttttccgcctggtcgaacacgatgctcgccgccgactcaaacacctcgtccgtcacctccatcccgccgtgcagatcgaactccttcgccatctgcttgccgagcgtagtctggtcgtcatggaacgccggcagacagtgcaggaacttcacgttcgggttgtcggtcagcgccatcatctgcgcgttcacctgatacccgcgcagcagcgcaatccgctctgcccacttctctttggcctcgcccatcgacacccacacgtcggtatagataaagtccgcgcccttaacgcctgccgccacgtcttccgtcagagtaattttcccgccgtgcttctccgccagcgcgctgcactccgccaccaggctctcttccggccagcaggctttcggggccaacaggcgcagatccagcccggtcagcgccgccgcttccagcatcgagttgcccatgttgttgcgcgcatcgcccgcgtagaccagcgtcatctcgttaaacgccttgcccggcaggtgctcctgcatggtcatcaggtccgccagcagctgggtcgggtggaactcgttggtcagcccgttccacaccggcacgcccgcatactgcgccagcgtttcgaccacttcctggccgtgaccgcgatactgaatgccgtcatacatccgcccgagaacccgcgcggtgtccttaattgactctttatgcccaatctggctgccgctcggccctaaataggtaacgcgcgcgccctggtcaaatgcggcaacttcgaaagagcaacgggtacgagtcgagtctttttcgaagatgagcgcgatgtttttaccggtaagcttctgtacttccttgccattttttttatcggctttgagctgtgcggcaagggtcagcagagaagtgaactgtgcaggggtaaagtcgagcagtttcagaaagtgttttttgtataaatcggacattttatcctcgcatggcgaacgccacttattgaattaaaattcactttatatgtgtaattattcatttgcaaccccatttcacaattctttcttacaaaggtggaggcaaacccgtccgtgtgtgaaaataatcgtatctgcctccgattctctgcagaagcagaaagacattggatcgaattctacaaccaggtcgagtcagaaatgagaatgattggccttctttatgattttaaggattatgcttctaaaatggcggagaacatggcgaggcttgctgccttacttcattacttcagcggtgatggaggcgatatatctgttaccgggtaatgactccaacttattgatagtgttttatgttcagataatgcccgatgactttgtcatgctgctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagcctgtcatacgcgtaaaacagccagcgctggcgcgatttagccccgacgtatccccactgttcgtccatttccgcgcagacgatgacgtcactgcccggctgtatgcgcgaggttaccgactgcggcctgagttttttaaatggcggaaaatcgtgttgaggccaacgcccataatgcgggcggttgcccggcatccaacgccattcatggccatatcaatgattttctggtgcgtaccgggttgagaagcggtgtaagtgaactgcagttgccatgttttacggcagtgagagcagagatagcgctgatgtccggcagtgcttttgccgttacgcaccaccccgtcagtagctgaacaggagggacagctgatagaaacagaagccactggagcacctcaaaaacaccatcatacactaaatcagtaagttggcagcatcaccgaattttcagcccggatgtttcacgtacctatgtcgaatatctggccgataaggttgcggatcgagaagaggatgcagaggaatatctggaagcaatcatggaggctcgtgttaccgttgctggcatggggctggtgatggaggtgcaggattacttcgatggcgaggccgatagactggcgaaggcgtggctggccgagtacacaccgcaaatcaagtcgttgaaagatgagcgtaaagaggcctatcgtcaaatcgtcgaaatgagtaccgaaccgcaggatgtggatctggtcaggccggcgaacaagtttgaaatgaccagggtgcgtgaaggtgaaaaggaagctgaccttccagtctggaaacaccatttgttgtgtgacgaaagcgggaactatccggctctgttgaaccattgggaaaccaaggtttttgagatcgaaaccaaacgtgaaggatttgctttctggtatcgtaatccacagtacacagggcagtcgtcactgggaatcgcttatgttgaagctgaacagtacaagattgttcgtcccgatttcctgttctttgccgaacaggatggcaaaatggttgtggacctggtagatccacatagcctacatctggctgatgctttgcccaaactggaaggacttgcgctatatgccgaacatcattctgatgcttacaggcgaatcgaatctgtcgccgaagtaaagggtaaattacgagtgttagatttgaaacggcaggatgtgcaggatgctgttgctaccgctgaaaatgcagaaacgttatttagtagcggacttgctgatgactatcagtaatctatagaaaattgcgtaacgaaactgcattttagtaattttttgaaacaatacaaataaggccttctcactgagaaggccattaccgacttacagttcgatttggctacagccgaagttacggtctccttcaccaaacactttgctttcaactttggtcaggtagtccagtcgggttaacagcgcctggtagttctgctggaagtcagtactattggtgtctagcacatacttacagttttcaggaaaatggaccagaccagggtgatcgtctctctccagtctcagggcgctgtaccaggctcctgtgatcatccctctaaggttatcgtcctgatcgtaatccccgaggtggtagtaagcgtctttgttgaacaacaggcaaatgtgatagtggcatttacctgattcagaatactctttcgcccatataataaataaagggcaacggtaaatgcgtttatcctcacgcaccttacgggtacggtcagcctccagcttagctctgagggattcacgcatccgggatatcaccccaggttccaggttagggaagcaacagatattgtcaccgttatcaactattttgggatagtggagatcgacacgtacagcaattaacctaggataccggttagtcaaataacataataatttattaatcttactctgatattcgaggatatgtactccatgagtaccttgatatgttttcataatatatacctgtatttggtcctacggtctatagcagaccgtacagggatgccatacaggcagggctattcctggtcactgttgtcggtatatactggtatcagattttagtacggacatactgatctgattactactcttactggtgaatacaggtagtaagagtacacaatgccattatataatacctatccaacatctaaatttgagacgaaggtagccccagcctgtgatggctgttaaaaagttactctgcaattagcttctggaattaaccgatgattccgttattccagtgccgcttcacagtcgataaactgatactcaatttctttgcaatctcagcctgagtaaatccacctttcttaagtattgtgatatcacgtcggtatttgcttccctcctttcgtcctaattttttcttaacatgtcgatatcggcttttagttgatttcagattgtgaatgtcaatcgtatcctgacgagcaatcaaaaaagacaagcaactttcagcagaaggctctatccttgaagctggatggtagctgtagataaacatttctttttgaaggcaaaaaaataaaatattctgtaagtcctccacagttctgccaagacagcttagatctggaatgacaagcgtgtcctgccggttcatttcatgatgaatcaattgtctgagtaaacgttgctctgaaacaacctctttaatatctacctgctcgatcacaacatgttcaggtagaatattaaatttttggcatatctcagcaagtgagtgatgatctgtaatgctttcttgctgttcgctactgcatatggtgtaaaaaaatgaacgcatctgatgcactccggtgtcataaattattttttgatacctgaataatgtcattttgcataaaaaacaaccaaaaatagagagtgattgccagcgatactttaactggtaaagtagtattttacctctcataattgtttgtccttctttgttacctcttaggttctgctctcttgtgagtatgggtttataatgatgtcatccggtacattaacacggttggaaacatctgttttgcggagcactggcagcataaccaccatttcattgacatggtaaatatcaatccaacaaacaaccggataaggcataacaatcccctttcttctaagaacttcatttatcccgaatataatcaattgggatgttgacaagagtagagcctgcccggcatcaaagtaataaccctcaaaggttgttctatgaataagaataatgtttgaatatcctgagacactttgatgctttacatcaaaatgtctttgattgtaaatgtaaatggctttttccatatcgtaattttcccttagcgaggatagcctttcacgtataactgttttttcatctttccccatgaattcatcattagcgttcagttgaaagtaatctgcaatggggatttttaatggactcatgatgttcgttttccagattaacgaacagtactcttccagagttacttctgttttacctcggcttcgattgatgctttcttttatagagaactttaacaggtcattttttatttcatttattgaccagttatgacgattgcatttttctaatatagggatagccaaatccacaacttccgctattacggaagagtgagatttatttgttagtctggcataatgatcaattactcctaatgaagattgatttttgaacgtgactgagtgtttttttatgggagtagtctgtactacctgtgactcattgtttttgccttgacaaggtttttttcctggtagaacgctgctcatctcaaaattagtaacactattagacatttttaaggaaacctctttgttatctcaatataaaactactatctgaaatttctcagtgttgccccatttttctcggggcaacatcgctataaatcaataaaattaaatctgtaatttattacagactttctcgtacagaaaatgtatctataaaatcgaggacatctttacgtaaccagtaatggcggccattgatttgttttgggcgaggtagcccctcaggcaatttgtcctgacaaagccatttacgaatggtttgagatttgtagctaatgattttagctaactcagctgttgaaatgagctgtgattgagatgtatccgggagtttgaatgcgctcattttgccacctcagtgattgagatattggcaaagaaagctttaagcattattgaattagtaggggtagtaatgaaggcagaaggaaacgtttcgggctcggggtcggggtcactaccatcacctgaatctgatgataaggcacttttagctgatttagccgtactgtgatgcgatctggatgcctgatttttacatgacatcagacgcgcgagaaagttagtagcattttgcattctttgtttaagatgtaaaattttcagtttggcgcatgcgacagacttgcgaagagctgagtatgttcctttgagatactcgacaacctcttccatggacgcaggatcgttaaaggattgagttgttttacttgaattaatacaccagcgagctctgatagctgccagagtgggttctatggatacagttgctggggttgccattggcttatctcctgtgtagttgctgtatcattgactaaactgtgtattacgatacatgaaaatctatcttgatcaatagttgatgatattttgtaatatgttgatttttaatggaatcaacgcatatcaacgttgttttttatggtaatacctgcttcatttaagatccatgtctcaattttctcgtgccattttcgtaacagatctaacggacgacggcgatagtgtttttcggcaagagcgctgggtttgtgtcccataatttgagcaacaataccagtgggaacttcaacccactcggccaaagtaccaaaactacgacgtaaaccgtgaaggctgatatgtggtaactcagccagcactaatgctctgttgtgcgctgaacgcggctcaataattttgccacttttactgttacttctgaaaacccaaccctccttatttacgtcagaatttggggattgcgctagtacatttaacaattcagaaacataaggagtgagagggatgatacgttcaccttcgatcttgtctttaattcgcatgcttgaccatttgaaatctacgtctgaccagcgaagcgacgcaatttcttcacgccgagcaccagtgagcaaaagtacttggagataggccgatgcaataggattattgaggctacgcacggcactaaaccagctttttagttgttccttttgcaggcaatcatcagctttactcgctgacacgggaaccatttttcttacgttgtaatcttgtgccagatcgccaggaatgatcccttgatattttttctgataattactccatttgatgaaagcacgtagtaggcgataagcgtgagcagtgacggtaggtctattttgcctttctgtactcagccacgctgctatgtaatctggggttagctccgataacggcaggttgagcaaactagccaatggtccagccgaagtcgggccttggcctctttttttactttcgcctccacgactggacaagttaatgtgatcggcaatgtatcgagtagaatatgggcgtttagtttttgcactgataccggttctcaattcttgaagatagtcttcccaggcgacggagaaagtcacttttgttttacgtgattctgcctgcagggattctgcttctgcgatttttacagccttagcaattcgtggatctatccctgtatcgatcaatgtttgtaaccgtcttgcctcggctctcgcatcatcaatcttccagtcgttaatgttgccaatagtcatgcgaagggttttccccgcatatacgctttggaatacaaaggcttttgctccgctagttgctcggcatgccagggttgttacatctgcatcccaaagaaaagtttgttttttcccttccggtaaggtgaatctgcgaagtctttcgaaggtaaatttttgtcttgaaagcgccatttttcggctccagttgagaattgctgtcttacaataatgtaactgctggtgtaagtaaatggagggaataaacatcaacttttgttaatttcaatcaacgggtttattgctataacttggtgttttataatataaagtatgttgttttgattgattgctcaagtagttaaaaatgcattaacatcgcattcgtaatgcgaaggtcgtaggttcgactcctattatcggcaccattaaaatcaaagagttaccccatatttaaatacaccacgtttcctcctgtgccgtatttgtgccattgtaaccttggcaattcatcaaaatactgttctgacatcaggcagtgcaggtgcagacatttaagccaattgctgccgccattctttgacgtagtcaatcagggcgcggagctttggtgcaatattgcgacgctgtgggaaatacagatagaagcccggaaattgtggaagaaagtcatcaagcagcgatacaagcttaccgctttcaatatatggcctgaaagtttcctgagtggcaattgttattcctccgccggcaagagccagcctcaacatcagacgcagatcattagtcgtaatctgcggttcaatcgcaaggtcgaaagttctcccgttttcttcaaatggccagcgataaggcgcaacctccggggactgacgccagccgatacacttatgggtatttcccccggaggcgagaaagcactctccacgcccggccgcaaggatcaggacgacgggggcaggcatgaatcctcctcctgatggagacgtacagaggcgacttctgccagcacggagagtgccagagtatgcgcatcccgggctttggggaatatcccgacgggtgcccggatttgcgttgtttcctccctggaccatcccagctcgtggagcttttgcagacgtaacgtgtgggttcgatagctgcccaatgcgccgagataaaagggttttgcttctcgcgcggcctgcaacactggcagctcccggttgagatcatggcacagcaaaatgaccgccgtatcggtatcgatctgagcgctggctgaggccggaaaaagatcgaagatatggctgtcatagcctgtggctgctgcaagactcgcggttgcctgcgcctcaagagaacgtccgtaaatcatcagcctgacgcatggcctgaaccccacctcaaagccattgagattccagcccgtccgggtttgcgtgggcaggcacaccagcgattgtgcttgcggatcgtagcgcagccccaccggttttctctgttccaggcggttcagcacggcgagcagaggctgtgccgagcgtagtttatggagcgtcagcgtgatcccaccgccgcagggcagaacgatgtcaaaccacggcgaaccttcgccatagcgaatttcgcgatcgcggcctgagcccatcatctccagcgcttcaaaagcggcagcggcctccacgcagccgccagagacaaaaccgcagtaacgaccatcttcgcgcaccaccatctgcgccccgagcgggcgcgccgcgccgccgcgtatctccaccagcgtcaccagcaccgctcctttaccggacattagcgcctctacggcgaagcgcagaatggtccggtggtcatcggtgagaaacgcctgctctggcttatgccagtgttcgtctttgtcaaaaagcgggtatgacattgttcctccttaaaccacatccggcagcttatcgagcagcttatccagagtgatgggataatcccgtacccgaataccggtggcgttatacaccgcgttggcgatagccgcgctcacgccgcacaggcccagctcaccgacacctttggccttcatcggggaggatatggggtcggtatcatccaggaaaatcacctcctgttttgggatatccgcatgaaccggcacctcataccccgccatatcgtgattaacgaagtagcccaaacggtcatccaccgccagctcctccatcagtgccgcgcccatgcccatagtcattgcgccaatgacctggctgcgcgcagttttcggattcaggatgcgtcctgcagcacacacagcgagcatacgccggacccgaacttctcccgtcgcgctatgcacgccgacctccacaaaatgcccggcaaaggtcgactgctggtactctttgctcagtgttccgaattcaatgctctcttccgctgtcagtctgccgcctgcggtggcttcatgtagcgtggcgcttcgggtaccgttggtaatcttgccgtcggcaaactgcgactgctcaggatcaaacccgactgccgaggcaatcatttcgcgaagcttcatacaggcggcgtaaacgccggaggtggaggtattcgcgccccattgtccaccagaacccgcagaaaccgggaaactggaatcgccgaggtgaaccgcaacctgctccagcggtacgccaagcatttccgctgccgtctgggccagaatggtgtagctgccggtgccaatgtcggtcatgtccgtttctacggtaacggtgccgttttgttcgaggtgaacccgagcacccgatttttccagcagattattgcgaaagcccgccgcaacaccgtggccgactagccactccccgtcgcgcacctgtccgggtgtggcgttgcgctgcttccagccaaatttatccgctccggtgcgcaagcactcgataagctgacggcgagagaagcagcgcgtcgggtcggcggggtcaacctgagtgtcattcaggatgcgaaactcgacgggatcgatgcccgctttttccgccagttcgtcgatcgcgatttcgagcgccatcagaccgggggcttcgccgggcgcacgcatggcgttcccttccggcaaatcaagcgtggcgagccgcaggccggtatgacgattcgccccggcgtagagtaattcgctttgctgtaccgccgtttccggcgtgccgccgggcaggtttccagaccagctttcatgtgagatagcggtgattttcccgctctggtcggcaccgatacgcaagtgctgaagggtggcggggcggtgcgtggtgttattgggaatagaggggcgggggagcatcactttaaccggacgtttcaccgctcgggcggcgagggccgccagcagcgcatcgcttctcaggaacagcttgccgccaaaccctccgccgatatacggggagataatacgcacattctccacgggaactttcagcgtttttgccagatcggtgcggcaccagtcaatcatctgatttgaggtccagagggtaagcttatttccatcccagacggccatcgaggcatgcggctccatcgccatatggctctggtccggggtcgtgtaggtagcatcaatcttcaccgcagcggaggtgaaagccccgtcaaagtcaccgacgtttttgtcgggcgtgtcttccggcggctgattgacggcctgtttttcgtccgccagggagtaagctcctttattacggcgatagtgtgcctgcaccagcgaggccgccgctcgcgcctgttcgaaggtctcggccactaccagcgcaatggcctgatgatagtgctcaatagtggggccgcctaacagcctggcggtgtttttgtcgcctttgccgagtgccccggcgttactggcggtaatgacagccagtacgcccggcgctttttgcgcggcgtccgtatcaagggcggtgaggcgtcctttggcaatggcggaaccgacgatatagccataggcggcgttgggggcttcttcatgccattcgtaggcgtagcgtgccgtgccggtagttttcagcggtccgtcgatgcggtcatggggacgaccgacaaccttcagctgatcgatcgggttttcccctgcgggtttatcaaatttcatgcctgtgccctcgcttcagccagtacggaggcaagcgttcgcttcgccaacaggagtttaaaggtgttttcagcggtgggatgggcgctggcgaacagcgtgtcatatacggcctgcgccccctgggatagctgagcatccgcagcctcaatgcgccagggcttatgtgctactccgcccagcgcgacgcgcccgctgccgtcaggctgaataatcgccgcgaccgataccagggcaaaggcgtaggaggcgcgatcgcgcaccttacggtagatatgttttccgccgagcggtggaggtaacgtcaccgcaacgataagctcaccgggaagcagggcggtttcaatgtgcggcgtttttcccggagggtgataaaaatcagccagtgtgatactgcgagtctttccctccggcgtgatggtttccaccaccgcatccagcaaccgcattgcgaccgccatatcgctcggatgggtggcaatgcaggcttcgcttacgcctaccaccgcgtgctgacggctaaagccttcaagcgccgcgcagccgctcccgggcaggcgcttattgcagggctgattggtgtcgtaaaaataggggcagcgcgtgcgctggagcagattacctgcggtggttgcctgattacgtaactgaccagacgcgccagcgagcagggcgcgggagagtaccgcgtaatcacgacgcacgcgctcgtgagccgccaggtcggtgttccgtaccagtgcgccgatgcgcagcccacccgcgtcggtcacttcaatcttatcgagcccgaggccgttcacatcgataaggtgggtgggcgtttcaatttccagcttcatcaggtccagcagattggtcccgcccgcgataaattttgcgccgggtacgcgctgagcgctaagtgccgcctcggctggggtattcactcgttcataggtaaacgccttcatgattttatctcccccgcagcatcttcaatggcggcaaggatgttagcgtatgcaccacagcgacagatgttgccgctcatacgttcacggatctcatcggcagttgtttctggagcggaaaccaaatcgaccgtgacgtgactgggaatgccgtcctgaatctcttttagcaccgctactgatgagcaaatttgcccggaggtgcagtagccgcactggaagccatcatgcttgataaaggccgcctgcatggggtgaagattatctggcgaacccaggccttcaatggtggtgatctcggccccctgatgcatgactgcaagcgtcaggcaggcattaagcctgcgaccattgaccagcacggtacaggctccgcactgtccgtgatcgcaacctttcttggtaccgatcaaatgcagattttcacgcaaagtgtccagtagcgtggttcgggtatccacctcaagctgctcggttttgccgttcaccttcagtgtcaggggcattatctctggcgcgggtgtagctgccggaacgcttgccgccagcgtagaatgaggataaaccacggcggtcgccgctgttgcggcgctcactttaatcagatcgcgacgggtcaaacttaaatcgtgcggctcgtgcttcccaacccgattatcttcggggtattcgccttggttgctcataccaggcctccggtattctaaaggggaaaataagagtgcgttgcgagagtgctgatgcttttttaaacgttaagcatagtcggcgacagcaggaggattattcttaaaacgcgaatgcagctatgagcccggctaataaattcatgttcgccgggatgttgatgatgatgggagctggtttattgctttagttgtacgatgcaaaaaccaataaggaaacctgtgattttcagctctacatcaccctgcaaatctctgtcacttctaatataaaaatagggagaaatgatggagcttatattcattggcgattaggaaactatcttgttatacaaaacaatacagttctttacatttgccttgttttatgaatactcctgaagaggtgtataacataatggtacaagcagggtagatatgaatatatttgaacaaactccaccgaaccgcagacgttatggtcttgctgcattcattgggctgattgctggcgttgtttccgcattcgtgaagtggggggctgaagttccattgccgccacgtagcccggtggatatgtttaatgcagcgtgtggcccggaatcattaatcagggctgcaggccaaattgattgctcgcgtaattttctcaatccaccgtatatttttcttcgagactggttggggctgacagatcccaatgcggctgtttatacctttgccgggcatgtctttaactgggttggtgttacgcacattatcttttcgatagtgtttgctgtcggttattgtgtggtcgctgaagtatttccaaaaattaaactctggcagggcttactggcaggtgctttagcccaactttttgttcatatgatttcattccctctcatgggactgacgccacctctgtttgatctcccgtggtatgagaatgtttctgaaatttttggacatttagtctggttctggtctattgaaattattcgcagagatttacgaaacagaattactcatgagccagaccctgagatccctttaggctcaaacagataatgcattgaatgataaaaatggcgcaaatacagcgccatttttataggttaaaaacattgctttttatattctgatgcagatagtcagtgagtatatcgcgctacttcaggatgatgtagatccgaagaacgctacagaagagaggcattgttgctggcaaatagaagaagtatcgggttttgttacccctgaaaaacgaagccccgctattatcgctggcggggcagtgcaattaattattgtatgtttataacggtgtcagcccgtatttagcccttgcacgattgcaagcctcattgacgactccgttctcaccagacatggcgaattctctgcatgtggacgatcgatttttatatatcgtgcagcaggcatttttgcccggggttcctgcaagggcaatacatcgggggtttttctgattggtaccgctcatgcatcggtgaaaaggggatatttgttcagtgagcctggcgggaatagtaccgccagcatcgtcggcttcggcccagtaaaaagagacgcggaaaaatgcacaacaggcaccacacgtcatgcatggattcagattgctcataattcaccagtacagctaaaaatcgtaaagagaacagcggtacatcgtatgtaagaacgtaccgcggttggctggggaactttcgatagtgtgagtattgaatgatttccagccgttaccgattttacgtactaattcgtgattaaaccactcgttagcaggctgcctgatacctttccgtgtctcctgaacactatggtgtgcatatgagaaagcccatcgttacaggtgatattgacgatcgcttccacatcatttaaacgatttttggggctctgaggtggaattcttccctcgaccgatggataagtcttagtccgccgaagggggcttagccggacaggaatcgctaatcttaatgaatttgtcgttatagaccagatagtgattccccggctgacgtaactcaggctgatgaaccacgtctcccggacgtagataccaggcatcgccttcctcttcggtcgaatcacatcctggcttaatcagtagcttaaaccatgtgttgccagtgttacttaccgttcctgtcaccttgtcgaaggaccatttaaactgaacctgacgtggtcgtactaccagaatggtatccatcaccaccaccggctccgtgctgaccacgccgccggttgggctgcgtcttgtatggttacgagtggggacctcgcgaaatgagacccggtagtagcgctcgcggttatcccgtggaccatgatagtaaaatttaaaatactcgctctcaccagcctgcaacgccagctggcggggggcgaaaagcagttcaccatccaccggtcgggtgcgcaattcactgctgcccgggctatcaatagcactgatggcaatacggtatatccgtgcgcttttgttgttattcactacacgtttgctgacaaagtcagtctcggacggcagcgaaaatgtcagattgccgaccgaaatcgcctgtgtcaaaggtgccgccagcatacagaccgctgtcagcagggccttagttaatgttacgccacgtcgcctgaacatgaatctctcctgaagcgctgacttcgccaaaccagccgttatcatctaccgtacgcagcgaaatggcgttatccattggaatcgaaaatttgactgtggtcttatccatctgccccacttcgccagagatatcagtccacggtgtggtcaaccacagcgcatcggtcatatcccgccagctatcatcgcacccggcatcgtaggtttttgtagctccgttgcgggtaataaaggaaagtgtcgccgggaacggtactttcgccttaccgtcatcggagctgaagacacaataggagcgcccgccaatcacctgcgcgggtccggtcaccttgatcagcacttcgtcggcagctgttttaccgctggtggttacgatatagccgaaatcgagtgccgactcgccgctgccaacatatccctcccgcgacggtgtctgagtatattcatcggagataatactgatgctgaaatcacggggtttgataatcagcgtgttggaggtagaaaattcataccagccagactccggtgatgtggtgttctgaaagcgaaagttgaatagatctttggtgttgatatcgctgatcccgaggttcaccatctgcttaaagaagttgctcgagaagaaaacatagatcgagtctgcgctcttcatctcgttgaaggtgtagtaataggcggtattgctcaccggtttccatgaactgccattcagactgaactgcatatcgtacgccccgacggccgaggctaacgacgagttggcgatcgccgggaatatatggattgaggtgttgctgagtccgtttgtttgcagggtatagttaaccatcttacaacttaatcctgaacggctgccgatggtttgcgtccggcagtcggcgttcccttcgcccagagtcggtactccgtcgctgttgataaatacttccgccagcgagtgggtatttatcaaccgtagatttgctgctttcgtatgggtgacgttgcgaacataccagttgccggaggcctgatccttacagcgtgcgccgctgctggcgtcatagttcacagaggtctggcaggcattgatggtcattgtaaagctgctgccgacgggcatttgttgcatatactggtaaaacgcgtctgacaacatgccgtgcatccacttcgcgccgccgctggtcaccgtcgcgccataaaatccactggcgtcggtggtttgcggcaggataagactggtggtcatattacacccagcgtaccagttgatgcagcgcaagccagttaaaggagatgaaactggtgaattttccagccacatatcaaacttccagttggtataaaggccggtgttgtaaccgttatcaatgtagccgaggctttgctgatagatggttcctgaaccagtgtattttaaaccggtccagcggttggcaccggtcaggcgcggatccagcgccccgccaggagtgacgaaaaagttgtcgtctgagttgttttcgacaaacacaaactcgcgtgccggtgcatccgcccaggttgttttgctcactgccgctctgagcgcagttactggccagattagcgcgaaaattatcatcgttattagtaggttaactctcattctcttctcctgtctgcgtcaccgccgcccacgatgagaggccgctgcagaccacatcaccgacccagacggcaccgcgcgcctggttgagttccagagccacttcgcaggttttattgccactgtagcgaaaatcgatagtggggtatttcttatccacgtccatgacaaactcgccgttttcatcggttcgggttcggccgatatggttgttaatccgtgcgttagccagcagtgtgccgtcttccgcacggatacgaccggagacggtaaccatctgcttcacctctggctcaatgacagcgacattgcctggatagagagtcagacgacttttgcggccgctgacgatatcgtaactgtcgagtgagtttttgctgttctgtaactccacctcatatcttccatagggagagagcgggagatagttacgcttgccgttaagcgggaaaatccgcccgttgattttggcgctgatctgaccgtcgtcctccagcccggtgttgaatatcaccccagcgttgccatcagtccgcccgctggcagcaatgtttttaccctgccagccgacgctgccattggcggtcaagttggtattgacgtagccgtccgccgcgctattgacgttcagcgttccgctggcgtaacgagcgtcgaattgtgcatacgccccgccgctgagggttttgtcatcaccggtatcgccggagatggcacgtgacagattggcaccaacagtgcgaatggttccttcatcaaactgtttgcgtgctgacaggtttgccatggtgtagccgttttgatgagtcatccctgcgctaaaccagttgcccagtggtagcgagagatcgagagcgatatattttcctgtattggcgttgctgtcgccgttgttatagcgctgaataccggcccgcaggccaagcgaaccaaaggtaccgctgtagacattttgatagtaatctgccgtgtaataatggctgttgtaacggcggtcatcattgtagctgatgctgaatgtgcccagcttcgaccacagtgagttcaggttgagtgtgccgccgattgcacggttgtcggcatcgctacgtcgcaattgattgccaatgcgggttttttcctgattaacccacagcgaactaaagcctcccggtagagtggcgctgatgctgccgatgctgctccatgagctgtcactggccagcatattttgcaggttaacgttgatcgcccccccaagcggcagcgtcagacgggtttcacccaccgcctgattatcgtatccatatcccgttgccgcccagctaagcgtactcaatgagccggaggtcgaggcacctgctagccaactctctttagctggtcgcgtctttttcccgttttccgaccagcgatccatatgaaagctaccgccccatacctgccacgccagtggtgcaccgacgccgcgcccccggctaaacagcttattgacccgctgggtgcgtttgctgatcacgcgaccgttaacgatcacctcaacttccacatcgtaaatcccgtacggtagaccccgggtatccacttcatgattgcccatagtgaagttctgaacgcttagtagccgcccatcacgggtgagatgtacttcgcccgccgccggtaaaaaggcgatcactggcgtggctgactggctgctgtcgaagatggtggagctggcctggtttccccaggaaaggccgtaaatcttccctgctgaaatggcggtcatcggccctaaggactgcaagttccaggtgtcgagcattccaccggcaaatcggtgaccggcaaaatcgcgttcatacatcgctttatataattcactgtcctgttgaccgctaccgatcccgtacagcgagccgtcgagcaccacatgatgttcgcgcagtgcagtaacgttattcagcgacagatagctggatgtgttgctcccgccgttacgcaactggttgttatagacgcccaagttatagctcagattactgctgagggtgttaacactggactgcccgatgtcttcgctacgtgagcgtagtacggtgcccagcgcttcgcgcttgaccactagctgcagcagcagttggcgcaagctgagatccagctgcgcgttgtcagtcagggggatggtaagggcctcattgaacggggcgttggccagagccatcagctgctgtcgagtttgttcgctgacactggcgttatcttcactctcttccagctgtattttccggatgcgtagctgtccatcgtccagccagataaaagcgctgccgattcgctgatcgtcctggcgaccctggctaccggcgagatgaatatagagcgggacgctcatgccgtcctgaagcgcctgactgaaggcctgcggaataatcaccccacctatttgctgcgcacttatgtcagcagcgctggcatcgggctgaacgaacaaaaagaccatgccgaaggcaaactgggctttcagtcctggggagaaccgtcgtaaaggcattgtcgttatccatctgcacagctatctatttcacgggaatgaacttatcaccctgccaaagtgcaacccgtcctttgttatccgcagtgtccacgcgggtaaaacgacgcgacttgcccggcatcaggtagtaattctctttacactccttaccgttggcggctttcaggcaaggtccgtaggcgaggatccgcagcgtcgcatttcctgtatttgtcagggagccgttggcgtactgaaagtggtagttcgcctgacgaggggcgacgaccagaatggtgccgatgcgggcggaagcagtggccacagcgctgcggttggcattatcgcgctgcgcatcactgagggcctgatcaaaccagacaatgcggtagtagcgctctttttcatctgcgggtcccttatagaagaagcggatcacttcgctggcttgggcgggtagcagcaagctggcgggagtgagtagcaactcatccggcttgtccattgagataacctgcccgtcgtcaagcggtgaagagagccgttcgagacggatattgataaggcgaccactgtcggtactgtttttgatcgttttgctcagcgtgctgctgtcactgttcataaacgatgatatatcgccgacatccagcgcctgggccggagatattccggaaaacagcagagcgagaggcagaaggtgctttttcataacaattccgtccaggaataaagcaggggggctacccctgctggtacatcagagagattaactggtccaggtcgcgtcgaactgtacgctaacgtcgccgctccagatgccttccggtagagtgctgtaatctgttactgcggtggtaccattggtggtaccgctgatgatggagaaggtgaaaccatcctgtgcggtggtacgattgctggcattgtaaccgttagccagcgggctaaggttgccgcccagtacgccgttggcggtatcgatcatcacggtatcgccagttttttcgactgccgcgccgttataatccacgcccacattcagtgtggaacctgaggtatccaactgggttaatgtgttggtgataagacgtgaggtcagtttaaaggcggtagccgttgagtcaccctcgatagccacgtcaaatagacctttctgtgagttaaaacctttaatgccttcggcatactggaacgccaggctaccgagtggcgtcacaaccagcttactggtggtgtcttttttggctgttgccgaccaggtcgctacagcctgagctgttacgtcagcagcctgcgccacacccatgccggtaaacaccgttaccagagctattgccagaaccttttttttcattgcatttcttcccgagttgaattgaggacgtgatgtcccagtgagtcattttttaaaactaacttgcctggagtttactgaaccaacttatatatttttgagtacagcttggcctcagcattacgccgatgggtatacactgtcttcacactacaattttcaattctggcaatcgatttaggttgcattccctgggccgtcatgcggataatttccatttcccggtccgtgattttatctttcttaatatcttttctcaggaacctgccattaatcacatagaccagttcttttctaatatcacgactcagtccagcgtataccacgcccctaatattgctattgtaataccaataatttgctaaggcctctgactttctggccgcaatcaatacgacctgtttcccctttaccgcggataaccattcattatcacggtttataaattcagataaagaatccgtactgagattgataaacacgaaatcttttctaattttctccaacgatagataaattaatctgtcgatatccacaatcagttcagatagtcctttatagaagtaggcgtcatggggagaccagatgtatttatcagaacggttttgacattccatatggtttttaacctcatagtccctactgtaatcactttgccatgtcactactttccaaacctgtaatttttacaggtgcattcagtttccttagtaaaccggaagtaaataagatacgtagtacatatcaataaaggttaaacgagattaagtttaattattttcgattgggcttaaatttatgttttttttcccgatgagtgtcaatatgtgaacggaaaaggaattcaatggttaagtcaatatttagaaaaactgaaaatattgcttttttgataagaagaaaaagacatttggtttcataaggttattggcaatataacgttcaattcttacttgcattttatattggtcaggaactttgccctgaagtgttaggaatagtcttaatgcgctgtgtgatggactagtaaaaaaacaagttttaagggtaagggatagaatataaaactatgatgagctgtcattgaagatgatttgccaatcagtaagatattttaatggattaacatgccgcacaaaatggttacaggtgttcattccaataagtaatggaaaattgaacgggcgtatgtacgtcatctgttcggtaagcccccaagagccagattaagtgaagttaaacgaaggctgccagctgtcacaggaacgatggcctttttgtcagggcactgcattcagttatctgtgcgcgttactctaactggcactcgaacgtcggcgacggggttaccggtggatcagactgttcctgtggcgtaaacgtttttatgttagtaccaacagatttaccacatttatcatcttaacagtttgagtgaaaatgcaggctgcgccgcaaagggaggagactgagtggcgtgttcagtctaaaagagggttgatgccagcatacaggggcgaagctggtcaacaagtcaacattaagataatggaatattcggagagaaacgtcaggcagttggcctcaaatgaacaggaagaatatatccccaggaaaattaatgttggtgttataaacacaccaacattaatccgatctgattattaatcagacaaatatcgttaatccgtcgaattttgaatcaacgttttttcttacgaccctgaacggccttaaaacgtggattagatttacaaatcacatatagccgtccttttcgcttcacaatctgacagtctggatggcgttcttttgcggtacgcagagagttaagaactttcatcacgccccctttttcgtgctaacaaaacgaccaaaacgttgggtgaatcgtgcaacatttccttctgatgccactgttctcagcttccctgtatagaacgggtgcgatttagaagagacatcaattgtcacgtatggatacgttacgccatccagctcaatctcacggtctgttttgatagtcgagccgattttaaagtactcatcaacactggtgtcgtggaacaccacagtacgatactcaggatggatattgggcttcatcatttttacctgttatgttataacataaccataaagatacatgctcatccggatcatttcaacactcaatccctgtgactctttgtggatgtggaattttcgcaacggggaactctggcattgttagcagccattggtgacgctcccataaacgcctggatgagtgattgatgatggttttgctgagagtatggatttttcgagaatggaggttatctccactttactggccgataatttatcgcagtatgattgattacctgacagcgtgtattcctctcccacggatataataattacttacaaaaaagggagaggatgcatattttaaatatcactgaagtgaacagtttatttccgttattaatagaaatggagaaataaataggcgtattctacaattgcgacaaaaacaacgatattaatcagtttatgactgatttgctgtactttattctctttcattggtacttcctcgctttaaaaaagagtgcacttcgtaagtgcccttatataaataacgagtttggtcaaccaattttttgacatgtatcacaaatttgaatagatgtattacatcaactatcttttattgcaccaacgtcattgatatatgtcgcctgaagtcagttccgggaatgagtctgatctcaagactggcccagtccgggcgttgattggtgctgaggagcatatcgcatctcatcataatgtcgtatctcctggggtgttatacaagatatcgttgttggtgacctgggagaggaattgagttctattaaaccgtcaactatgccggatacatactggattacactgcaggcacgccttatgagagaacgtgccgcagtgacgggttaattatctgaaagaatttgtgaggctgtatcggttactcattgatttgatagttttactctcgggagaataatagatatttaatccattaacggaaaccagccagttcctttcgatgcctgaatttgatcccatagtttatccggaatggttaattcatgaacaagttgtgttatcgttcatgagaagcataacgtaaagggaaaagctcgattagacggcagaatttgtcaggggttatgaacgaaattcataaatctgtttgagtgttgcgatgggtagtgcaagttcgatatctccgcaatttacagtccgatgaaggaaaatgaatatccataaaaaatatattggtttatcctggcatatatacctatttcgacgtatttccaatagttttaattaaaggcaggtcattgttattcactctgaatagtgaattattcactgtccgcagagtaagaaatataacttaggtatctatttaatgacttgcacaaaaagctaaattttcccccataaataaaaatataatcccgcgcccaaccacctgatgagtggctataggcactggatatattaggtggcggtgcactttcttacataaaggtatttccttttctgcggaaaaggaaatcgggaaatccccggtttttctgacaagcagacgccattatttgtgtctgcctatgttcgttaattcgttcatcaggaaattatctcaatgtcacattataaaacaggtcataaacaaccacgatttcgttattcagttctggcccgctgcgtggcgtgggcaaatatctctgttcaggttctttttccactcgctgtcacctttaccccagtaatggcggcacgtgcgcagcatgcggttcagccacggttgagcatgggaaatactacggtaactgctgataataacgtggagaaaaatgtcgcgtcgtttgccgcaaatgccgggacatttttaagcagtcagccagatagcgatgcgacacgtaactttattaccggaatggccacagctaaagctaaccaggaaatacaggagtggctcgggaaatatggtactgcgcgcgtcaaactgaatgtcgataaagatttctcgctgaaggattcttcgctggaaatgctttatccgatttatgatacgccgacaaatatgttgttcactcagggggcaatacatcgtacagacgatcgtactcagtcaaatattggttttggctggcgtcatttttcaggaaatgactggatggcgggggtgaatacttttatcgatcatgatttatcccgtagtcatacccgcattggtgttggtgcggaatactggcgcgattatctgaaactgagcgccaatggttatattcgggcttctggctggaaaaaatcgccggatattgaggattatcaggaacgcccggcgaatggctgggatattcgtgctgagggctatttacccgcctggccgcagcttggcgcaagcctgatgtatgaacagtattatggcgatgaagtcgggctgtttggtaaagataagcgccagaaagacccgcatgctatttctgccgaggtgacctatacgccagtgcctcttacccagcaatagtggacacgcggctaagtgagtaaactctcagtcagaggtgactcacatgacaaaaacagtatcaaccagtaaaaaaccccgtaaacagcattcgcctgaatttcgcagtgaagccctgaagcttgctgaacgcatcggtgttactgccgcagcccgtgaactcagcctgtatgaatcacaactctacaactggcgcagtaaacagcaaaatcagcagacgtcttctgaacgtgaactggagatgtctaccgagattgcacgtctcaaacgccagctggcagaacgggatgaagagctggctatcctccaaaaggccgcgacatacttcgcgaagcgcctgaaatgaagtatgtctttattgaaaaacatcaggctgagttcagcatcaaagcaatgtgccgcgtgctccgggtggcccgcagcggctggtatacgtggtgtcagcggcggacaaggataagcacgcgtcagcagttccgccaacactgcgacagcgttgtcctcgcggcttttacccggtcaaaacagcgttacggtgccccacgcctgacggatgaactgcgtgctcagggttacccctttaacgtaaaaaccgtggcggcaagcctgcgccgtcagggactgagggcaaaggcctcccggaagttcagcccggtcagctaccgcgcacacggcctgcctgtgtcagaaaatctgttggagcaggatttttacgccagtggcccgaaccagaagtgggcaggagacatcacgtacttacgtacagatgaaggctggctgtatctggcagtggtcattgacctgtggtcacgtgccgttattggctggtcaatgtcgccacgcatgacggcgcaactggcctgcgatgccctgcagatggcgctgtggcggcgtaagaggccccggaacgttatcgttcacacggaccgtggaggccagtactgttcagcagattatcaggcgcaactgaagcggcataatctgcgtggaagtatgagcgcaaaaggttgctgctacgataatgcctgcgtggaaagcttctttcattcgctgaaagtggaatgtatccatggagaacactttatcagccgggaaataatgcgggcaacggtgtttaattatatcgaatgtgattacaatcggtggcggcggcacagttggtgtggcggcctcagtccggaacaatttgaaaacaagaacctcgcttaggcctgtgtccatattacgtgggtaggatcataaagtcctcgggtcgttgtccactcttttggcatgtcagcatattcacataccgtaccagcaaaagtttcaaccgtgagcaaatcgaccgattttgttgacggttcaaacgtggaaacgaaatagatatccgtcttaaaattcttcatacatctggctaaatgatgacgtcgtagtttgacttcttcatccggtgatttattcgacacttcaatgtcatatttaaatgagttgccaaaaataggtgtctcaggaaagttgattaatctacactccgtcttttgctgttgacgtattaaaaaagaagggaagatatttgcgagatcccaataatcacggtggcggtattcacggggagagcagccgaataactttttaaattcgcggctgaatgactgctgtgaatcaaaatgcaaagagagtgcaatatcaagcatagatttcgcggtgagccggacaagaatggcggcacgacaaagccttcgtttgcgaatgtattctcccaaaggcacatgcatgaaatttcggaacagaagctggatgttgcgtctgctgtagccagatttctgtgcgatatcttcgattgaaatagggtgctcaagattgcactcaatccactccaggagctgctgtagaatcttctgcctgatcatctcattctccgttaattctttgtcatatcgcacattttcgttataccctgggccctaagtgtatcaaaaatagcaagggcgaaggcaaaagcactggtagcgtctgcttcgttgtccccgaaaatagagaggtttcagtcctacattattaatgaattttttgcataagtgatatcaaaatccacatactactttgaggttacgttttaacgtagactcattgttcatgcctaatggagggactgacagtggaattttccgtatagtctgcttcagagtattgcagatgcccatcaaaaatcgatttctcactgacagataaagaaatggcacaaattagttcgcttgatttgggttatgttggggagtcggtaaaacattttaatcctgaatttgttcgtggttgtcttgctgtaaaaatacatgattgatattaatcatgtattttacctaagacgacaaaaaccttttaacagggagtgatattgatcttcactctgtcatatctccggtaatatggcgtcaggcttcatcatcagaaagggggcctgacgcctgaaaaagtgaacaacagacagtgttcggattatcaatattcagtttttaacgttgaactggattcattactgcgttgtttaagaatttcccgcgccgaatctgccattatcatgactgcacctgccagcatcagagtatctttcaataccaggcgaccagcaccggataaataagggaaaccatgatgagcgtcacccaatgcgggtacccatgcctccggggtggtgattaaaaatgagagtgttaccagcggcgtggtaaatgccatcagtcctcccaataaacctaaccagcgattgacaggattagccaaaaccagcagagcaataatcacctccacgacgccaagaccgttggaaaaaccataggtattattggccgtttgccatgcccttgcttctggtttgtattcgccttcgtgagtcagatactgtttatagtcttccgggtgttcataaaagaacgacattagtggactgtttgcgacgaatggtgtaatgctgtctgcctcgtaagggacaaactttaataacccaatccacataaaaacaattgcaatactcagacgaatcaatgtcaggccaattttatctccccgacttaacaggtgcaggtatttttccattgtgaacatccttatttatacaatactgctgttgcggttgaattattatcaattcgcatcgatgtgactttccaggatgaagcattatattttctggctatatcagcaatggtatcctccagaactgtcggtgatgctgatactgacgagacgctgatatgtttcagaattattttatcatctgcattggtggaaaatgccataacgccagataatagtgttgcaaataaaacagattttttaaacatataaaataccatcaatgaagtgattaagaagttatagagtaacagagaattaataagattcttttctctgagacgccagaatatttgttctggcgtctgattttgagtttatttgactaatgaaaatagatcattgagtgattcgctcatcgacggatgagtaaatatctgatcgcgtaatatgctataaggcagcccggcatccatcaccattttcactatattgatcatctcgtgggagtcaacacacagcagtgatgcccctaacatacgttgggttttattatcaacaatcgcttttaataccccacgagtatcattcatcactctggcacgcggaattgcagctacaggcaatgtcaccacctgaatatcagcaccactctctctggcttgttcttctgtcataccaaccctggacaggggcggtgtcataaatacggaataaggcacatttttccgatcatcagtactacgtttgccttcacccagtaactcatcacgtacaatgcggtaatcatccagtgatatgtaagtaaattgcagcccgccggtaacatctcccatcgcccaaatattgtctgcggtggtatgtaatcgcttgtcaacgacaattgccccgcgctcgtttactgcgataccggcattttctggatgtaacgaagcggtagccggttgacgaccggaagctattaacagtgcatccaccgccagttgggcgtgctcgctatgcacttgcacttgattttcatggtgactgattcgctccacatgggcattgaggataatatcgacgccctgatcgcgtaaaatcgtcgcgatattatcagcaatatcccgatcttcccgaggcaaaaacagcgaagctgcttctaaaatggttaccttgctgccaaaattagcgaacatagaggcgaactcaacgccaatatatccgccgcccaaaatacctaaatgcccaggcaattcttttagattaagtaatccggtgctgtcatatactcctggcgtggtggtaattccaggaattggcggaaccacggtttgtgcaccggtattaataaaaattttctcgccatgaatttccagatttccctcaggccgatgaacacgcaggctatgattattgataaactccgcctggccgtcgatcacgtcgatattgggcatatccgcaagattatgaaaattcttattacgtaaaaaattaaccacttcatttttacgctgtatggcacggacaaaatctgtgtgctgctgtgcgtcatgaaccaatgttttggttgggatgcagccgatattaatacaggtcccgccatacattgcatttgattgttcgatgagagccactcgccaacctgcttttgccagcgtgacggctaatgtttttccagccttgccaaaaccaataatcactgcctgatatttattcatgatgatttcctgtcgaaacgcgttcatttgacatcatgactatagacgcaaaagagcaaataacatttcttcacaacgcttgatattttgtcttatcgtctgatattttctttttcttaatcagaatcacaaaacaaaaatcatgattaactatttgatggtattagattagttatttactaagattgttggtgtttgtaatcaaaaaccactcaggagtctgatatggatgcccttagccgtttgttgatgcttaacgctccacaaggaacgatcgataagaattgcgtgttaggaagtgactggcagcttccacatggtgccggggaattatcggttattcgttggcatgcgttaacgcaaggagcggcgaagctggaaatgccgacgggggagatttttacattacgcccgggaaatgtggtcctgctaccacaaaattcagctcatcgcctgagtcatgtcgataatgaatcgacctgtattgtctgcggcactcttcggttgcaacattcggcgcgttattttttaacgtctttgccggaaacgctgtttttagcaccggttaaccacagcgtggaatataactggctgagggaggcgatcccgtttttacaacaggaatccagatcggcaatgccgggagtggatgcactgtgtagccagatctgcgctacattctttaccctcgcggtgcgtgagtggattgcacaggttaatactgagaaaaacattctcagtttgcttctgcatccacgtcttggtgcggtaatacagcaaatgctggaaatgccaggacacgcctggaccgtcgaatcgctggccagcatcgctcacatgtcccgggcaagttttgcccagcttttccgtgatgtttccggaaccacgccgctggctgtattaacaaagttgcgtctacaaatagcggcccagatgttttcccgggaaacgctccctgttgtggtgatcgctgagtcagtaggctatgccagtgaatcatcttttcacaaggcgtttgtccgcgagtttggttgtaccccgggagaatatcgggaaagggtcagacagcttgcaccctgaataaaaccgccagaaatcagggcaaagataatccgcattccgggagttgtgagcctttcaactatttctatttccaacggtggtttgggctttatatattttttctgatggactctagctcagtttttaaataaaaatgcaaactaaattgcttcaattaaataaaatcccgactattacttgatacgtgattattgtcggtgatttttttgtacaccatcagtgtatatctcaataacccctgaataagtagctctgaataggtataagggatgtagccatttttaaatggatttcttatgccaaaaatgatcgtcgatttccccataaaatgtgagcgatgccgaaagaaataaaattagttattgcatttgacgtttggatgaaagattatcatttgtcatacaaatgaggggtggtatgttgctagccaattaaaaaagaacgccatatttattgatgattgatcccccggtgggggggaaacatcgggcataaatgggcatgaagtaatggagtattagttgtgaatgtcaatttctttgtcacctgtattggtgacgccctgaaatcaagaatggcacgagactccgtgctgctactggaaaaactcggctgtcgcgtaaatttcccggagaaacagggatgctgcggtcagcctgcgatcaatagcggttatatcaaagaagcgattccagggatgaaaaatctgatcgccgcactggaggataacgacgatcccattatttcaccggctggctcttgcacctatgccgtaaaaagttacccgacgtatctggcggatgaacctgaatgggcatcacgtgccgcaaaggttgccgcgcgtatgcaggatctcacctcttttattgttaataaattaggggtagtcgatgtaggtgccagtttgcaagggagagcggtgtatcacccatcttgtagcctggcccgtaagctgggagtgaaggacgagccacttacgctgctgaaaaatgtgcgtggactggagctgttgacctttgctgaacaggatacctgctgcggatttggcggcacgttctcggtcaaaatggccgaaatatccggcgagatggtgaaagaaaaggttgcgcacctgatggaagtccgccctgagtatttaattggtgctgacgtgagttgcctgctaaacatcagtgggcgattacaacgggaagggcagaaagtcaaagtgatgcatattgctgaagtgttgatgagccgctgaggatataaagatgtcgatcaaaaccagtaatacagattttaagacacgcatccgtcagcaaattgaagatccgatcatgcgcaaagcggtggcaaacgcgcagcagcgtattggggcaaatcggcaaaaaatggtcgatgaattggggcactgggaggagtggcgcgatcgggccgcccagatacgtgatcatgttctgagtaatctcgacgcttatctgtaccagctctcagaaaaagtgacgcaaaacggcggtcacgtctattttgcaagaaccaaagaagacgctacccgctacattttacaggttgcccaacgcaaaaatgcccggaaggtggtgaaatctaaatcgatggtgaccgaagagattggtgtcaatcatgtgttgcaggatgctggcattcaggtgattgaaaccgatctgggtgaatatattctccagctggatcaagatccgccatctcatgttgtggtcccggcaattcataaagatcgccatcagatccgtcgagtgctacacgaacgtctgggctatgaggggccggaaacgcctgaagcgatgaccttattcatccggcaaaaaatccgcgaagatttcctcagtgctgaaataggtattaccggctgtaatttcgcggtggcagagaccggttcggtatgcctggtgaccaatgaaggtaatgcgcgaatgtgtaccacgctgcctaaaacgcatattgcagtgatgggaatggagcgtattgcccccacgtttgccgaggtagatgtattgatcaccatgctggcgcgcagtgccgttggtgcacgtttgacgggatacaacacctggctgacaggaccgcgcgaagctgggcacgttgatggtcctgaagagtttcatctggttattgtcgataacgggcgttctgaggtgctggcctctgaatttcgggatgtgctgcgctgtattcgctgcggggcttgtatgaatacttgtccggcatatcgccatattggcggtcatggatatggctctatttatccagggccaattggtgcggtgatttctccgctacttggcggctataaagattttaaagatttaccctacgcctgctctttatgcacagcttgtgacaacgtgtgtccggtgcgtattccgctgtcaaaactgattttgcgtcatcgtcgggtgatggctgaaaaagggatcaccgcaaaagcagagcaacgggcgataaaaatgttcgcttatgccaatagtcatccaggattgtggaaagtcgggatgatggccggtgctcatgcggcaagctggtttatcaatggcggcaaaacaccactcaaatttggcgcgattagcgactggatggaagcacgcgatcttcctgaagctgacggagagagtttccgtagttggtttaagaaacatcaggcgcaggagaaaaagaatggataatcgaggcgaatttttgaataacgttgctcaggcactgggtcgcccgctgcgacttgaaccgcaagcagaagatgcgccgcttaacaactatgctaacgagcggcttacccaacttaaccaacagcagcgctgtgacgcgtttattcagtttgccagcgatgttatgttgacgcgctgtgagctgaccagcgaggcgaaggcggcagaagctgcaatacgtctgtgtaaagagctgggagatcagtcggtcgtgattagcggtgacacgaggctggaggaattggggattagcgaacgtttgcagcaggaatgcaatgccgttgtttgggatccggcgaaaggtgccgagaatatctcgcaggcagagcaggctaaagtgggtgttgtgtatgctgaatatggtttaaccgaatcgggaggcgtggttcttttttccgccgccgagcgcgggcgttcattgagcctgctcccggaatattctctttttatcctgcgtaaaagcactatcctgccgcgtgtagcgcaactcgcagaaaaattgcatcagaaagcgcaggccggtgaacgaatgccttcctgcattaacatcattagcggccccagttcaacggcggatattgagcttatcaaagtcgtcggagttcatggcccggtgaaagcggtgtatctgattattgaggattgttgagagagatatgaagtctggacataaacctgaagaaggcatacgaggttgaaaatagcgtttaggacaacctgacttaaccccgttccgtcatggttatgctgctcttctgtaaatatcctggtattaccaatgccaggatatttacagtgaaaaagacaggcatccattcctgaaaacgggttcccttcccggtcattgtcacttcagctttatacaggcactctctatcagaatgttgtttattactgcccagagttttgttggtattcatctaccatttttttgacaaggcaaaacattacagaaattacaatgcttagaaaaaatcccagagccaggcaaatggcagcagggtatttattttttatttctggtgagcttatagttacacagccatcaccgttcggatacaatgaccagttcctggtcaggtatatcatttttgtataaagctcactgttaattgctgaaggcgtttgtatctcatcgagaacttgcctgccattatgatattctgacgcataccatttgataatagaggcctgcacgcgagatatttcctcttcagcagttggtaaagctctcttatctcctgaccattccagccttatttctctgttcttgacatctgggctggtgtgaaaaaatgtagtaattcgctgaataacatcttcagtcattgtagtctgacaggcaaaattattattgctatcacagctaacaagtatacctggcgttgtctggtttatttttaggctgtaaatcacttttatattgtctttattgatatacagaaacaacagcaccatagccatacatatagccataataaaaaggataacacgaatctttttcttcagataaaataaaatctcaatcagatcgatatcctgtttgatttgttcacgcataatatatccagagaataaaatctgtcgcagataaggttgtattaatagtctgtatcaggaatgttcgggttaaatatcagcaaaaagcccgcatcatgaatactggatatgaagcatgagagttacctcagtgtttatataaggattcggtccccctctctggaacggtaactctcaatctgatcggttcctgcgttagttcacatcacgactcattttttcgctctcaccggcatcccatttgccacaaaatatcccgccgtgctcctcggcagcgcttcctgtccacgaatcatatccgctattttctcgccaatcataattgtcgtggcgttcaaattcccggtgataatctgcggcataatcgacgcatccaccacacgcaggccttctaacccgtgtacgcggccttcgccgtcaaccacggacatctcgtcgtaacccattttgcaggtaccgcacggatggaaggcggtttcggcgtggttacgcacgaactcatcgagctgttcatccgtctggcattcgacaccggggctgatttcgcggccacgatactgatccagcgcgggttgatgcatgatctcgcgggtgatgcgaattgcgtcgcggaactcctgccagtcctgctcgtgcgacatgtagttaaacagaatcgccggatgctggtgcgggtcgcgggatttaatccgcacatgcccacggcttggcgagcgcattgagccgacgtggcactggaaaccgtgctctttcactgcattcgagccgttatagttaatcgctactggcaggaaatggtactgaatattcggccacgcaaattcctcacggctgcgaataaatccacctgcttcaaagtggttgctggcaccaacgccagtgccgccaaacagccactccgcaccgattttcggctggttccaccactgcagggcagggtagagggaaaccggttctttgcactcatattgcagatacatctccagatgatcctgaagattttcgccgacgccgggtaattcatgcaccagcggaatatcaaactccgccagcagttcagcgttgccgacgccggagcgttgcaggatctgcggtgaggcaatcgcgcctgcacataacagcacttctttgttggccgttgcgcgggttgggatggtgctgtcgccttccagccattcgacgcccaccgcgcgtttgccgtcaaaaatgatgtgatcggtcatagcgtgagtacgaatggtcaggttaggacgcgatttggcctgatcgagatagccacgcgcggtgctggcgcgacggccctgcggcgtgacggtgcgatccatcggaccaaaaccttcctgctgataaccgttgagatcgtccgtgcgcgggtagcccgcctgcacgcccgcttcaatcatcgcttcaaacagcggattgacgccgggtttggaggtagtgacgctcaccgggccatcaccgccgtgatagtcgttttcacccatatcgcgagtctcggccttgcggtagtagggcaggcagtcgaggtagctccagttctccagaccgggttcttgcgcccagttatcgagatccagcgcattgccacggatgtagcacatgccgttgatcagcgacgatccacccagacctttaccgcgtccgcactccatgcggcggttattcataaacggttcaggttccgtttcataggcccagttgtagcgtttaccctgtagcgggaatgccagggcagcgggcatctgggtgcggaagtcaaagcgatagtccgggccgcccgcttcaagcagcagcacggaggtattcggatcttcagtcagacgggtagcgagaacgttgccggctgagccggcaccaataatgatgtagtcaaattgcaaataaacctcctggttagaatatggactggaatttagccatctcaacctggatggacttcacctgggtgtaactctggagcgtcatcacgccgttctcgcgaccaatgccggagtgtttgtagccgccaacgggcatctctgccggggattcgccccaggtgttgatccagcaaatacccgcttccagctgatgaatgacgcgatgcgcgcggttcaggtccgctgtcacgatgcccgccgccaggccgtagtcggtatcgttagcgcggcgaatgacttcgtcttccgactcgtaggtcagaatggacatcactggcccgaagatctcttcacgcacgatggtcatatcgtcgctgcaatcggtgaacactgtcggtgcaacccatgcgccgttatcgaagccatcgcctttcagtacatcgccgccgcacagtacgcgcgcgccttcctctttgcctttggcgatatagcgcagcacgttatcgcgatgcgggaagctgaccagcgggccgaagttagtttgcggatcgaaaacgtcgcccgcgcgaatgcgctcaacgcgcgccagaattttctgctcaaatgcggctttgcatttcgccggaacgaagacgcgggtgccattggtacacacctgaccggagctgaagaagtttgccatcatggcgatatcggcggcgagatcgagatccgcatcatcgaaaacgatcagcggtgatttaccgcccagttccatggtcacttctttcagggaagaggccgccgagttagccatcacttttttgccgctggcgacaccgccggtaaatgacactttggcaatgcccggatgctcggtcagatattgcccggtctccgcgcccacgcccggcaacacgttaaatacgccgtccggcaggcccgcttcgctgtaaatttcagccagctttaacgcggtaagcggggtaacttcgctcggtttgaaaatcattgcgttgcctgccgccagcgccggggcggatttccacagggcaatctggatcgggtagttccatgcgccaatccctgccactacgcccagcggttcgcggcgggtatacacaaaggacgtttcacgcaacgggatctggctgccttccagcgccgggatcagcccggcgtagtactccagcacgtccgcaccggtaacgatatcgacggttgaggtttccgaatatgcttttccggtgtcgagggtttccagttttgcgagttcgtcattgcgttcacgcagaatatcaacggcccgacgcagaatacgcgagcgctccatggcggtcatcgacgcccagattttttgcccctgctgggcgcttttcacggcgcgatcgacatcctcgcgcccggcggcctgcacggtcgccagcacgttaccgttggccgggttaatggtctcgaaggtgcgaccgctggtggcggaggtataaccaccatgtatataaagctgctgttctgccattcgggacatcacgtctcctcggttaatcggtgggtagatgctgagtgataaagtggcgggtcagggaattagcgcgggttttatccagcggtttgccgctcagagccgcgcgcagccataatccatcaatcagcgcggccaggccgtagcccgcttcctgtgcctgttcgcgcggcaattcgcgacgaaactcgctcaccagattcgacagcaagcggcggctgctgacctgctgtaaacgatagagcatcggctgatgcatactgctggcccagaacgccagccaggctttcatcgccgcactgctcacctgcgtttcatcgaagtttccgccaacaatcgcctgtaatcgctgctctgcactgccctgcggaagtgcatgtaatcgattcaaaaccgcgtcacgcagctgactggtgatatcgcgcatggttgcttccagcagaccatttttgtccctgaaatagtggctgatgatccccgtagaaacgcctgcacggcgggcgatctgcgcgatcgttgcatcgtgcatgcccacttcatttattgcttccagtgtggcgtcgatcagttgtctgcgccggatcgactgcatccccaatttgggcattttcgccactccattcatcagcggtgtttatctattaaagcggttattgattggacgttcaatataaaatgtgtcttaattgttacgaatttgattttaaatagtaacaataacagtggggatactggatgacagacctttcacacagcagggaaaaggacaaaatcaatccggtggtgttttacacctccgccggactgattttgttgttttccctgacaacgatcctgtttcgcgacttctcggccctgtggattggccgcacgctggactgggtttctaaaaccttcggttggtactatctgctggcggcaacgctctatattgtctttgtggtctgtatcgcttgttcgcgttttggttcggtgaagctcgggccagaacaatccaaaccggaattcagcctgctgagttgggcggcgatgctgtttgctgccgggatcggtatcgacctgatgttcttctccgtagccgaaccggtaacgcagtatatgcagccgccggaaggcgcgggacagacgattgaggccgcgcgtcaggcgatggtctggacgctgtttcactacggcttaaccggctggtcgatgtatgcgctgatgggcatggcgctcggatactttagctatcgttataatttgccgctcaccatccgctcggcgctgtacccgatcttcggtaaacggattaacgggccgataggtcactcagtggatattgcagcggtgatcggcactatcttcggtattgccactacgctcggtatcggtgtggtgcagcttaactatggcttgagcgtactgtttgatattcccgattcgatggcggcgaaagcggcactgatcgccttgtcggtgataatcgccacgatctctgtcacctccggtgtcgataagggcattcgcgtgttatcggagcttaatgtcgcgctggcgctgggattgatcctgttcgtattgtttatgggcgacacttcgttcctgcttaatgcactggtgctgaatgttggcgactatgtgaatcgctttatgggcatgacgctcaacagttttgccttcgaccgtccggttgagtggatgaataactggacgctcttcttctgggcatggtgggtggcatggtcgccgtttgtcggcttgttcctggcgcgtatctcgcgtgggcgtaccattcgccagttcgtgctgggcacgttgattattccgtttaccttcacgctgttatggctctcggtgttcggcaatagcgcgctgtatgaaatcatccacggcggcgcggcatttgccgaggaagcgatggtccatccggagcgcggcttctacagcctgctggcgcagtatccggcgtttacctttagcgcctccgtcgccaccattactggcctgctgttttatgtgacctcggcggactccggggcgctggtgctggggaatttcacctcgcagcttaaagatatcaacagcgacgcccccggctggctgcgcgtcttctggtcggtggcgattggcctgctgacgctcggcatgctgatgactaacgggatatccgcgctgcaaaacaccacggtgattatggggctgccgttcagctttgtgatcttcttcgtgatggcggggttgtataaatctctgaaggtagaagattaccgccgtgaaagtgccaaccgcgataccgcaccgcgaccgctggggcttcaggatcgcctgagctggaaaaaacgtctctcgcgcctgatgaattatccgggcacgcgttacactaaacagatgatggagacggtctgttacccggcaatggaagaagtggcgcaggagttgcggttgcgcggcgcgtacgtggagctaaaaagcctgccaccggaagagggacagcagttgggtcatctggatttgttggtgcatatgggcgaagagcaaaactttgtctatcagatttggccgcagcaatattcggtgccgggctttacctaccgcgcacgcagcggtaaatcgacctactaccggctggaaaccttcctgttagaaggcagccagggcaacgacctgatggactacagcaaagagcaggtgatcaccgatattcttgaccagtacgagcggcaccttaactttattcatctccatcgtgaagcgccgggccatagcgtgatgttcccggacgcgtgattgttattgcataaaaccgcgccatgtctgcatatggcgctgtttctcctacctcttgatacgttatatctatacggttaagcccttagtatctattgatgattaccagacaacagataataaaaaagaaaagaactattgcagcccaaaacctacatttgggctgttgcgaatgttcaataagtttagtcttatttaatgtaaatattgctgatcatttgaaatgacgcattattcatgagaaatgtgtatcgtaaatcaactgaaattaacgcaaccatttgttatttaaggtttaattatctgtgtgtgatattttattgaatgttttaaatattgtttttattggcattgctataatattggttatcatttgctgaatggattcagtcttaatgagtgggtttttaagggacaggcatagagtaatgatacgtatgcataaccaacatctttactcattatgtcattgaatgttgacgctatgtgtttatgagggagaggtattttcagttgatctggattgttaaattcatataatgcgcctttgctcatgaatggatgccagtatgtagtgggaaattataaatattgaaatagtccaactacttctttattaccaaaaatgagtatctgaattttaatattgcattcttgcgtgattatctcctgagtttgacttgtgattacctttttaaggtatttagcgtaactgtttttgagcgagcatcagaggtaaagataatcttcttgatagtgatgtgggatgttatacgtatggcatcgctgatgtttatggttaccccttatgtgtgctcaggaatcgacaggtaatcactcatactgaacagcgataaaagataaaggtgtgttcatgaattcatgtgattttcgtgtttttctgcaagagttcggtacaacggttcatttgtcattgcctggtagcgtatccgagaaagaacgactgctactcaagctgctgatgcagggaatgtctgtaacagaaatatcacagtacagaaatcgcagtgcaaagacaatttcacatcaaaagaaacagctctttgagaaactggggattcagagcgatattactttctggcgcgatattttctttcagtacaatccggagatcatatccgccacggggagtaatagtcacagatatattaatgataatcactatcaccatatcgtcacgcctgaagccatcagtctggcgttggaaaaccacgaattcaaaccgtggatccaaccggttttctgcgcgcagactggcgtactgacgggctgtgaggtgcttgtccgctgggaacatccacaaacgggaattatcccaccggatcagtttattcctctggcggagtcatccggtcttattgtcataatgacccgccaactgatgaaacagactgcggatattctgatgccggtaaaacatttgctgccggacaatttccatattggcatcaacgtctcggcgggttgttttttggcagcgggatttgaaaaagagtgtctgaacctggttaataaattaggtaacgataaaatcaagctggttctcgagctaacggaacgtaaccctattccggtaacgccagaagccagagcgatatttgacagccttcatcagcacaacattacctttgcgctggatgactttggtacgggttatgcgacctatcgttacttgcaggcgttcccggtcgattttattaagatcgataagtcatttgtgcaaatggcgagtgtcgacgaaatctccggtcatattgtggacaatattgtcgaactagcgcgtaagcctggtctgagtatcgtggcggaaggggtagaaacccaggagcaggcggatttaatgatcggtaaaggcgttcactttttgcagggctatttgtactctccgccagtaccgggtaataaatttatctctgaatgggtaatgaaagcaggtggttgatgtaaaccgctattcacagcgcatcgggaggttggcagcgattaattctcccgatgcagtaaatcctgatagatccccgttaatatgccatttggcgcaaattgttttttaatccactgcgtcacctgacccgtagcagaatgctgagtcgccagtaacatgcgcgaatcctggcgcggattatggatttgtcgggtaaccagcagggattgcgtcatcgcctcacggaccatgtaatccggcaaaaaaccaattccttcacctaaaatctggcactgacatttggtgttgaaatctggcaccagaattgactcctgcccgtgcagcaaccagcccacttttttattaatcgtatgcgcggtgtcctccaccataatattagggtagagacgcagttggctttcggcgatgggttccggcacaaaggctaacgggtgatccggggcgatagcaaaagcccagcgaatcgcgccaatttcagtgtaatcaataccgccgccgtccagtagtgtatcgggtgcgccgatggcgatattggcctgattattaataatcgcatcccagacgccgttatacacttcggtggtgacggtaatctggcaggtaggaaactgctttttcagcacctgtaacaagcgtgcggtgtgtttgggcgtataaagcagctgattaatacaaatgcgcacacgcgcttctatgccctgcgaaatagtatcgattctgcgtttgatggcataaaaatcattcagcaggtcggtagctttgcggaaaaaataacgcccggactccgttaactcaatgctgcgggtactgcgagtgaacagcaccacatccagccccgtctccatacgcttaatggtgtagctaatggcggaagtggttaaacccaactcttctgcggctttactgaagctgccaaaacgcgcagcggtagtaaatgccaacagattctcttcggtaaaaattgagttcattaaaccattctcgccattatctactatgaatttctccagctatgactgtagaggtatcggttaaagatagataatcatttttgaataacttttaatacccgtcgcgtttagtcgtcgcttcgcttaatttttgtccaccatattctgaaattacccccacgcagttacccgccagaaaacccagtaacgtcaccgtccagttcatcccgctggcaaaaaacagcgtcatgccgagaaagccaccgggaataaaggacagtaaccagaaacgcccttgccagaccactaccgccgagaagggtacggtagtaattacgctcgcccagaacgcggacagtccacttacagaggccagccaaccagcagtcagcgcggcgaaaaacgcccacaccatcccggaataattaaccgccagacttctgataaaccccgatttaccgccgcctgcggcataaaaactgcaaaaggcgacgaagccaatggttcctaataattcccatccttgagagagcccgacatgtgaagacactaactgccaaagccctgcacaaataccgacggtgacacccgttgccgtgagtccgttcatcttgttcccctctggttagacatggacgaaagctactcttacatgtgcagactatagagaaataaaacctgattgagtgaaagggtatcgggtcaaagaaacaaatattgcactaccgcacactgcgaaaagattgttgaatattattcaacaaaaaggcgagatacggcgaattaaatttaagcgggttcttttatcagattatcgttgctattctcaattcatcgaaaacagccacaaaaaccaggggaatgtgaatgagtataaaaaatctacctgccgactatttattggctgcacaacagggtgatatcgataaagtaaaaacctgccttgcgctgggtgtcgatattaatacctgcgatcgtcaggggaaaacggcaattacgctggcaagtttatatcagcaatatgcttgcgttcaggcattaattgatgccggagcggatattaataagcaagatcatacctgtttaaatccttttttaattagctgtctgaacgatgatttaacgctactacgaattattttaccggctaaacccgatcttaattgcgtaacccgttttggcggtgtcggcctgacgcctgcctgtgaaaaaggccatttaagtattgtaaaagagcttttggcgcatacggagattaacgttaaccagaccaaccatgtaggctggacgccgctactggaagcgattgtgcttaatgatggtggtattaaacagcaggcgattgtgcagttattgctggaacacggtgccagcccgcatctgaccgataaatatggcaaaacgccactggaactggcgcgggaacggggctttgaagagattgcgcagttactgattgccgcaggtgcataaaccgggaggcttgctatcaacacaccagaaagacggtgtgtgtgggcgctaactgcggatgcggattttctggcgcagcgggggcaaggacaggttgaacaggtctttgccagagcggtaaatatcgcactcccggctcgccagcagttgctgacgctgctttgtgaagagtacgacaatgcgccaaacagttgtcggttggcactcactcactttgatgatctgttccggcatggtgataaggttcagtttgacgatcaaggtattacggttggtcaacatcttcatatagagatgagtcgttgtcggcgttggctgtccccaaccttgcaaatgaccgctgtgaattttcaccttatcgcctggctacagtggcacgacattattcatcagcacctgggggaaaatgaaaccctgtttaattatcgcggcgataatccgttttatcaggcgttaaataaagaattacatattaaacgacgggcagttattcaggccgtaaacgataaacaaaatatcgcctcagcggtcgccagtatgatggggttagggattggccttacgccatcagccgacgattatttaacaggtctggcgcttattttatttattcccgggcatccggcggaaaaatacaaagaggaattttatctcggtctgcaacgcggcaaaaataataccacattattaagtgccataacgctggaagccgcattacaacaacgctgccgggaaaatattcatcgttttattcacaacattatttatgacatccctgggaacgcaactcaggcaatagaaaaaattaaacatattggctccagttccggctgcgacatgctgtatggcatggccgatggttgtgcgctgagccaaacctacggagggaattatgtcagttaaaatagtcattaaaccgaatacctattttgattctgtctcgctgatgtctatctccacgcgtgcaaataaactcgacggcgtcgagcaggcatttgtggcgatggcgaccgaaatgaataaaggcgtgctgaagaatttaggactgctgacgccggagctggagcaggcgaaaaacggcgacctgatgattgtcatcaatggtaaatcgggtgcggacaacgagcagttactggtggagattgaagaactgttcaacaccaaagcgcaaagcggctcgcacgaggcgcgttacgccactattggcagcgccaaaaagcatatcccggaaagtaacctggcggtgatttcggtcaacggtctgtttgccgctcgcgaagcgcgtcaggcgctgcaaaacgatctcaacgtgatgctgttttccgataacgtctcagttgaagatgaactggcgctcaagcaactggcccacgaaaaagggctgctgatgatggggccagactgtggcacggcgattatcaacggcgcggcgctctgttttggtaacgccgtgcgtcgcggcaacatcggtattgttggcgcatccggcaccggcagtcaggagttgagcgtccgcattcatgaatttggcggcggcgtttcgcaactgattggcaccggcgggcgcgacctgagcgagaaaatcggcggcctgatgatgctcgacgccatcgggatgctggaaaacgatccgcaaactgaaatcattgcgcttatctccaaaccgcctgcgcctgcggtggcccgcaaagtgctggaacgtgcgcgcgcctgccgcaagccggtggtcgtctgcttcctcgatcgtggcgaaacgccagtggatgagcaggggctacagtttgcccgcggcaccaaagaggcagcgctaaaagcggtgatgctctccggcgtgaaacaggaaaatctcgacctgcatacgcttaaccagccgttgattgcggatgtgcgtgcgcgtctgcaaccgcagcagaaatacattcgtggcctgttctgcggcggcacgctgtgcgacgaaaccatgttcgcggtgatggaaaaacatggcgatgtctacagcaacattcagcccgatccggaattccgcctgaaagatatcaaccgcagcatcaaacacaccttcctcgactttggcgatgacgacttcaccaatggcaagccgcacccgatgattgaccccaccaaccgcatcagtcgcttgatcgaagaggcgcgcgatccagaagtggcggtgatcgtgatggattttgtgctcggatttggatcgcatgaagatccggtcggctccaccatcgagacgatcaaagaagcgaaagcgatcgccgctgccgaaggacgcgagttgatcattctcgcctatgtgctgggtaccgatcttgatacgccatcgttagaacaacaaagccagatgctgcttgatgccggagtgattctggcgagcagcagcaccaataccggattgctggcgcgtgaatttatctgcaaaggggaggaagcctgatgagccagtcactgtttagccaaccattgaacgttattaacgtcggcatcgccatgtttagcgatgacctgaaaaagcagcatgtagaagtgactcaactcgactggacgccgccggggcagggcaatatgcaggtggtgcaggcgctggataacattgccgattcgccgctggcggacaaaatcgccgccgctaaccagcaggcgctggagcgtattatccagtcgcatccggtgctgattggttttgatcaggcgattaacgtggtgccgggcatgacggcgaaaaccattcttcacgccgggccgccgatcacctgggaaaaaatgtgcggcgcgatgaaaggcgcggtcaccggagcgctggtgttcgaaggactggcgaaagatctcgacgaggcggctgaactggcggcttccggggagatcaccttctcgccgtgtcacgagcacgactgcgtgggatcgatggcgggtgttacctcggcctcgatgtttatgcacatcgtaaaaaacaaaacctacggcaacatcgcttataccaacatgagcgagcagatggcgaagattttgcgtatgggcgctaacgaccagagcgtgattgaccgcctgaactggatgcgtgatgtgcagggaccaatactgcgcgacgcgatgaaaattatcggcgaaatcgatctgcgcttaatgctggcgcaggcgctgcatatgggcgatgagtgccataaccgcaataacgccgggacgacactgctgattcaggcgctgacgccggggattattcaggcgggttattccgtcgagcaacagcgcgaagtgtttgagtttgtcgccagcagcgactacttctccggcccgacgtggatggcgatgtgtaaagcggcgatggatgcggcgcatggcatcgaatacagcaccgtggtcaccaccatggcgcgtaacggcgtcgagttcggcctgcgggtcagcggcctgccggggcaatggtttaccggcccggcgcagcaggtgatcggcccgatgtttgccggttataagccggaagattcggggctggatatcggcgacagcgccatcaccgaaacctacggtattggcggatttgctatggcgaccgcgcccgctatcgtcgcgctggtgggcggcacggtggaagaagctattgatttctcccgtcagatgcgcgaaatcaccctcggtgaaaaccccaacgtcaccattccgctgctcggttttatgggcgtgccgtcggcaatcgacatcacccgcgtgggtagcagcggcattctgccggtgatcaacaccgccatcgcccataaagatgcgggcgtcggcatgattggcgcgggcattgtgcatccaccttttgcctgcttcgagaaagccattcttggctggtgcgaacgttacggcgtctgacctacatgttcatgccggatgcggcgtgaacgccttatccggcctacgaatggcgcaagaatctgtaggcctgataagcgtagcgcatcaggcatttgtcaccattgccggatgcggcgtgaacgccttatccggcctacgaatggcgcaagaatctgtaggcctgataagcgtagcgcatcaggcatttgccaccactgccggatgcggcgtggacgccttatccggcctacgagtggcgcgagaatctgtaggcctgataagcgtagcgcatcaggcatttgtcaccattgccggatgcggcgtgaacgccttatccggcctacgagtggcgcgagaattgtaggcctgataagcgtagcgcatcaggcagtctggcgttggtcataaccccatcaccctctgtagcggacataacaacatgaaagagcttgtggtcgttgccattggtggcaacagcattatcaaagataacgccagccagtcgattgagcatcaggcggaggcggtgaaagccgtcgccgatacggtgctggaaatgctggcttccgattacgacattgtgctgacccacggcaacgggccgcaggtcgggctggatttacgccgtgcggagattgcccacaagcgcgaagggctgcccttaacgccgctggcgaactgtgtggcagatacgcagggcggcatcggctatctgatccaacaggcgctgaataaccggctggcgcgtcacggcgagaagaaagccgtcaccgtggtgactcaggtggaagtggataaaaacgatccaggttttgcccatcccaccaagcccatcggcgcattctttagtgacagccagcgtgacgaattacaaaaggcaaaccctgactggtgttttgttgaagatgccgggcggggctatcgccgcgtggtcgcctcgccggaaccgaaacgtattgtcgaagcacctgccattaaagcgctgatccaacaaggttttgtcgtaattggcgcgggcggcggtggaattccggtagtgcgtactgacgcgggagattaccaaagcgtggacgcggttatcgacaaagatctctctaccgcgctgctggcccgtgaaattcacgccgacattcttgtgatcaccactggcgtcgaaaaagtgtgtattcactttggcaaaccgcagcagcaggcgctcgatcgggtggatattgccaccatgacccgctatatgcaggaagggcatttcccgcccggcagcatgttgccaaaaatcatcgccagcctgacatttttagaacaaggcggcaaagaagtgattatcaccacgccggaatgcctgcctgcggcgctgcgcggcgaaacgggcactcatattattaaaacgtaaggacgtaagatgaaagaaagcaatagccgccgtgaatttctgagccagagcggtaagatggtcaccgccgccgcgctgtttggtacctctgtgccgctcgcccatgcggcggtagctggcaccctaaactgcgaagcgaacaacaccatgaaaatcactgacccgcattactatctcgataacgtgctgctggaaaccggttttgactacgaaaatggcgtggcggtgcagacccgcacggcgcgccagaccgtggagattcaggacggcaaaattgtcgccctgcgcgagaacaagctgcatccggacgccacgctgccgcactatgacgctggcggtaagctgatgctgcccaccacccgcgacatgcatattcatctcgacaaaaccttttacggcgggccgtggcgctcgctcaatcgtccggcaggcaccaccatccaggacatgatcaaactcgagcagaaaatgctgccggaactgcaaccgtacactcaggagcgggcagaaaaactgattgatttattgcagtcgaaaggcaccaccattgcccgcagccactgcaatatcgaaccggtttccggcctgaaaaatctgcaaaatttgcaggcggtgctggcgcgacgtcaggcgggctttgagtgtgaaatcgtcgccttcccgcagcacggtttgctgctgtcgaaatctgaacctttaatgcgtgaagcgatgcaggcgggggcgcattacgtcggcggcctggacccgaccagtgttgatggcgcgatggaaaaatccctcgacaccatgttccagattgcgctggactacgacaaaggcgtcgatattcacctgcacgaaaccactccggcaggcgtggcagccatcaattatatggttgaaacggtagagaaaacgccacagctgaagggcaagctgaccatcagtcacgcctttgcgctggcaacgctcaacgagcaacaggtagatgaactggcgaaccggatggtggtgcaacaaatttctatcgcctcgacggtgccgattggcacgctgcatatgccgctcaaacagttgcacgacaaaggcgtaaaagtgatgactggcactgacagcgttatcgaccactggtcgccttatggtctgggcgacatgctggaaaaagccaatctgtacgcgcagctctatattcgtcctaacgaacagaacctctcccgctcgctgtttttagccactggcgatgtattgccgctgaatgaaaaaggcgagcgtgtatggccaaaagcgcaggatgacgccagctttgtgctggtggacgcctcctgttccgccgaggcggtggcgcgtatctcgccgagaaccgcaacgttccataaagggcaactggtgtgggggagtgtggcaggttgatgcgcatttgaaacgcctgcaacggtgaatagtaagagatttaagccccagggagtggggcaatctgaatatgagtgtgtcggcagaaatggacattatctttgaggaatatgcccttattgacgttgtgtagataactatttgtctacgtgaaaagatcatcagttttgccgattttagtcttttacagatagcaaatatcacacttacaggcgctcgccttatggggaacgttgctgctctgtttcattcaggctcgcggcatgttggggctggatcgggtggtttaaatattggctatattcaatggacgcgttttgccgcgatgacatatcaggcgttgccaaatacacatagctaatcaggagtaaacacaatgaagatcaaagctgttggtgcatattccgctaaacaaccacttgaaccgatggatatcacccggcgtgaaccgggaccgaatgatgtcaaaatcgaaatcgcttactgtggcgtttgccattccgatctccaccaggtccgttccgagtgggcggggacggtttacccctgcgtgccgggtcatgaaattgtggggcgtgtggtagccgttggtgatcaggtagaaaaatatgcgccgggcgatctggtcggtgtcggctgcattgtcgacagttgtaaacattgcgaagagtgtgaagacgggttggaaaactactgtgatcacatgaccggcacctataactcgccgacgccggacgaaccgggccatactctgggcggctactcacaacagatcgtcgttcatgagcgatatgttctgcgtattcgtcacccgcaagagcagctggcggcggtggctcctttgttgtgtgcagggatcaccacgtattcgccgctacgtcactggcaggccgggccgggtaaaaaagtgggcgtggtcggcatcggcggtctgggacatatggggattaagctggcccacgcgatgggggcacatgtggtggcatttaccacttctgaggcaaaacgcgaagcggcaaaagccctgggggccgatgaagttgttaactcacgcaatgccgatgagatggcggctcatctgaagagtttcgatttcattttgaatacagtagctgcgccacataatctcgacgattttaccaccttgctgaagcgtgatggcaccatgacgctggttggtgcgcctgcgacaccgcataaatcgccggaagttttcaacctgatcatgaaacgccgtgcgatagccggttctatgattggcggcattccagaaactcaggagatgctcgatttttgcgccgaacatggcatcgtggctgatatagagatgattcgggccgatcaaattaatgaagcctatgagcgaatgctgcgcggtgatgtgaaatatcgttttgttatcgataatcgcacactaacagactgaaaaaattaataaataccctgtggtttaacatattaacttcgctctccacttaactttttagttaaggagagcgaaataatatcaaagtagcagtaaaacctataacgtaaatttaaattgttaaattaacgccctccagtacacaatacttcacacgttagttatgagcgatttctgatagtgcctggtttaatcagagctttattatctgcgacgtttatttttatttaagagagatcgcgatgatatcattaaaagctccgcacaataatttgatgccatatacgcaacaaagcatacttaatacggttaaaaacaatcagttaccagaggatatcaaaagctccctggtttcctgtgtcgatatattcaaggttttgattaaacaatattatgattatccttatgattgtcgtgatgatttagtcgatgacgacaaactcattcatctcatggctgccgtacgagactgtgagtggtcagacgataacgcactcaccataaatgtgcagtttaatgatttccctggattttatgactggatggattaccctgatcacccggttaagtttgtttttcacatacttgaaaatcaaaaagggacagtttgggtatatgaccaggatgatgcgtttcttgatattaaagcaaacgtgcaggctggacgctttaccgggcttaagaaattagtgcagtttatcgattcagtgcgaacagattgcaaatgtattcttcttgaataccatatgcctttgctgagaattttccctaaagggaaagagtgtatgcatgtggaaaaatggcttcgcgaaatgtcgtctattccggagacagacgcgcccattaagcaggcgcttgcgcatggattattattacacttaaaaaatatctaccctgtttttcctgaatcactggtgatgttattgctctctgttctggacgtaaaaacatacagagatgatgcgcgattaaatgaatggatatctaatagagtgcaggaattaggtgacagatattatcctgtaaataagcacgttaaaatccgctacactctttagttcagaaagggttccacctgcaagttgttattccacctgagagtgaatcgcaatgcaggtaatcatttcatctgtatatctgtatgccaactggcattccatctcttttttcgccgatattttgttgtgatcggcgacacttcgcttaaaaaagcaccagtagtggtttcgcagccatgcggtgtataaaaaatgatctcatgcagatgttttgtgaatgtgttggttgacattcatatgaaaaaaatcataattccatcatgtttgtgtggggtcttttctgtatcttacgcatcgcactcaagcctgacagaaaatatgctgtaaggctcatatcaaaaaccgccattagctcatcaggaagagcagacgacaaccaggattgttgtatggtacggggttcgaggcctcgatggcggtccaacttttcaaaactcttctgaatcagatccccttattatcatccctgcaaagtggaacattgccattgtttggctattcaggatggggcagaccaatgaaaaaagcccacacaggggagagtgggctgaaatgggaagctaaagactcaagtaaacttatcggaaataaggaccacgcattacgggggctatcatcgccgatggccgtgattcggcaaatcaggttgattacgtagagagtaaattatctgctcaccgctgcgtcaccccttcgtaaatcaggcgtagcgcgaatacaccaataattgcaccaataacccgactggcaacgcgttgcatacgcccataagcacgacgcacagcgggcaaagaaaacgcctgactaagaaaaactcgccagataattgatgcgagcacaatccccgcccaggccattaaacgtgcccatgttggtgtttcggcatttaatgttactgagaaaatactgataaaaaataaaacggtttgcgggttagagagatcggtaattaatccgcggcgaaaaaagacataccagggggcgctaatcggttgttgtagtgtgctcatttgcggtgttgactggcggcgcatgctgcaccacgcaaaccataagagataagcgccgccgacgattctgataagcgaaaaaatctcctcacactgcgtaattagcgttgcaagaccaaacaaacccaacccggaataaaatgcatcgcccagcgccacgcccagcccggtcagcacccctgcgcgtcgaccggaagccaggctggtttgtactaccacaaagagattggctcccggattaaaaaaagtaatcacgaacagtcctacggtcaggtaaacggcatgcaaaggatccatagtgatttcatccataaataagtgaactaactgcatcatatttctaccaaaaataatcgggtgcgagagagatcacaaagtgtcttatttccggttactggcgtttatgccctgactgaactaattattaatcaacccaataatgtgggtgggtgatagtgtgataacaactctggagccgtaatatgaaaataatctctaaaatgttagtcggtgcgttagcgttagccgttaccaatgtctatgccgctgaattgatgaccaaagcggaatttgaaaaagttgaatcgcagtatgaaaaaataggtgatatttcaaccagcaatgaaatgtcgactgcagatgcaaaagaagatttgatcaaaaaagcggatgaaaaaggggctgatgtgttggtactgacctccggtcaaactgacaataagatccacggcacggcaaatatttataagaagaagtaattctgaatcctatgtaaacatctccgatgcgtaagtttatcggtgatcatctattgaaatttatgccggataaagcgttcgcgctgcattcggcagttcagcttttcagccgccgccagaacgtcgtccggctgatgcctaaataattcgccgctgctgttttatcgccattaaatttctccagtgcctgttgtggtgtcagtaagcgtggagcgggagttttcgccgactcgcgcgccagttccggcagtagcagttgcataaactgcggcgttaaatccggcgtcggttccacacttaaaaacagcgccagtcgttccatcatattgcgcagttcacgaatattgcctggccagtcgtagtgcagcagcacagtttcacttgcctgtaacccctggcgtaatgcagcagaaaatggggcggagagcgccgccagagacactttcaaaaagctttccgccagcggaagaatatccgccacccgctcgcgcagtggtggcaattgcagacgcaaaatactcagccgataaaacagatcacggcgaaaacgtccttgctgcatatcttcttccagattgcagtgagtggcgctaatgacccgtacatctaccggaacaggctgatgcccgccgacgcgggtgacctctttttcttccagcacccgcagcagccgggtctgcaaaggtagcggcatttcgccaatctcatccagaaacagcgtaccgccgtgggcaatttcgaacagcccggcgcgacctccgcgtcgcgagccggtaaacgccccttcctcatagccaaacagttctgcttccagcagcgattcggcaatcgccccgcagttgacggcaacaaacggatgcgactttttgccctgtcgcgcatcgtggcgggcaaaatattcccgatgaatcgcctgggccgccagctctttgcccgtccccgtttccccctcaatcaacaccgccgcactggagcgggcatacagcaaaatagtctgccgtacttgttccatctgtggtgattgaccgagcatatcgcccagcacgtaacgagtacgcagggcgttgcgggtggcatcgtgagtgttatggcgtaacgacatgcgcgtcatatccagcgcatcgctgaacgcctggcgcacggtggcggcggaatagataaaaattccggtcattccggcttcttctgccaaatcggtaatcagccctgcgccgaccaccgcttcggtgccgttagcttttagctcgttaatctgcccgcgtgcgtcttcctcggtaatgtagctacgttggtcgaggcgcaaattaaaggttttttgaaacgccaccagcgctggaatggtttcctgataggtgacaacgccgatagaagaggtgagttttccggcttttgccagtgcctgtaacacatcgtagccgctcggtttaatcaaaataactggcactgacaggcggcttttcaggtacgcgccgttagagccagccgcgatgatggcgtcacagcgttcgtttgccagtttcttgcggatgtaggtcactgctttttcaaagccaagctgaataggggtaatgttcgccaggtgatcaaactcgaggctgatatcgcgaaacagctcgaacaggcgcgttacagataccgtccagataaccggtttgtcgtcattaagccgtggtggatgtgccatagcgcaccgcaaagttaagaaaccgaatattgggtttagtcttgtttcataattgttgcaatgaaacgcggtgaaacattgcctgaaacgttaactgaaacgcatatttgcggattagttcatgactttatctctaacaaattgaaattaaacatttaattttattaaggcaattgtggcacaccccttgctttgtctttatcaacgcaaataacaagttgataacaaaggatgggctatgtctctacactctccaggtaaagcgtttcgcgctgcactgactaaagaaaatccattgcagattgttggcaccatcaacgctaatcatgcgctgttggcgcagcgtgccggatatcaggcaatttatctttctggcggtggcgtggcggcaggttcgctggggctgcccgatctcggtatttctacccttgatgatgtgctgaccgacattcgccgtatcaccgacgtttgttcgctgccgctgctggtggatgcggatatcggttttggttcttcggcctttaacgtggcgcgcaccgtgaaatcgatgattaaagccggtgcggcaggattgcatattgaagatcaggttggtgcgaaacgctgcggtcatcgtccgaataaagcgatcgtctcgaaagaagagatggtggatcggatccgcgcggcggtggatgcgaaaaccgatcctgattttgtgatcatggcgcgcaccgatgctctggcggtagaggggctggatgcggcgatcgagcgtgcgcaggcctatgttgaagcgggtgccgagatgttgttcccggaggcgattaccgaactcgccatgtaccgccagtttgccgatgcggtgcaggtgccgatcctcgccaacatcaccgaatttggtgccacgccgctgtttaccaccgacgaattacgcagcgcccatgtcgcaatggcgctgtacccactttcagcgttccgcgccatgaaccgcgccgctgaacatgtctacaacgtcctgcgccaggaaggcacgcagaaaagcgtcatcgacaccatgcagacccgcaacgagctgtacgaaagcatcaactactaccagtacgaagagaagctcgacaacctgtttgcccgtagccaggtgaaataaaaaacgcccgttgattgtattcgacagccgatgcctgatgcgtcgctgacgcgacttatcaggcctacgaggtgcactgaactgtaggtcggataagacggatggcgtcgcatccgacaaccgatgcctgatgcgccgctgacgtgacttatcaggcctacggggtgcactgaactgtaggtcggataagacgcatagcgtcgcatccgacaaccgatgcctgatgcgccgctgacgcgacttatcaggcctacggggtgcactgaactgtaggtcggataagacgcatagcgtcgcatccgacaaccgatgcctgatgcgccgctgacgcgacttatcaggcctacggggtgaactgaactgtaggtcggataagacgcatagcgtcgcatccgacaacaatctcgaccctacaaatgataacaatgacgaggacaacatgagcgacacaacgatcctgcaaaacagtacccatgtcattaaaccgaaaaaatctgtggcactttctggcgttccggcgggcaatacggcgctctgcaccgtgggtaaaagtggcaatgacctgcattaccgcggctacgatattcttgatctggcgaaacattgcgaatttgaagaagtggcgcatctgctgatccacggcaaactgccgacccgtgacgaactcgccgcttacaaaacgaaactgaaagccctgcgcggtttaccggctaacgtgcgtaccgtgctggaagccttaccggcggcgtcgcacccgatggatgttatgcgcaccggtgtttccgcgctcggctgcacgctgccagaaaaagaggggcataccgtctctggcgcgcgggatattgccgacaaactgctggcgtcgcttagctcgattctcctttattggtatcactacagccacaacggcgaacgcatccaaccggaaaccgatgacgactccatcggcggtcacttcctgcatctgctgcacggcgaaaagccatcgcaaagctgggaaaaggcgatgcatatctcgctggtgctgtacgccgaacacgagtttaacgcctccacctttaccagtcgggtgattgcgggcaccggctctgatatgtattccgcgattattggcgcgattggcgcactgcgcgggccaaaacacggcggggcgaatgaagtgtcgctggagatccagcaacgctacgaaacgccggacgaagccgaagcagatatccgcaagcgcgtggaaaacaaagaagtggtcattggttttggtcatccggtttacaccatcgctgacccgcgccaccaggtgattaaacgtgtggcgaagcagctctcgcaggaaggcggctcgctgaagatgtacaacatcgccgatcgcctggaaacggtgatgtgggagagcaaaaagatgttccccaatctcgactggttctctgctgtttcctacaacatgatgggcgttcccaccgagatgttcacaccactgtttgttatcgcccgcgtcaccggctgggcggcgcacattatcgaacaacgtcaggacaacaaaattatccgtccttccgccaattatgttggaccggaagaccgcccgtttgtcgcgctggataagcgccagtaaacctctacgaataacaataaggaaacgtacccaatgtcagctcaaatcaacaacatccgcccggaatttgatcgtgaaatcgttgatatcgtcgattacgtcatgaactacgaaatcagctctaaagtggcctacgacaccgcacattactgcctgctcgacacgctcggctgcggtctggaagctctcgaatacccggcctgtaaaaaactgctggggccaattgttcccggcaccgtcgtacccaacggcgtgcgcgtccccggaactcagttccagctcgaccccgtccaggcggcatttaacatcggcgcgatgatccgctggctcgatttcaacgatacctggctggcggcggagtggggccatccttccgacaacctcggcggcattctggcaacggcggactggctttcgcgcaacgcggtcgccagcggcaaagcgccgttgaccatgaaacaggtgctgaccgcaatgatcaaagcccatgaaattcagggctgcatcgcgctggaaaactcctttaaccgcgtcggcctcgaccacgttctgttagtgaaagtggcttccaccgccgtggtcgccgaaatgctcggcctgacccgcgaggaaattctcaacgccgtttcgctggcgtgggtggacggtcagtcgctgcgcacctatcgccatgcgccgaacaccggcacgcgtaaatcctgggcggcgggcgatgccacttcccgcgcggtacgtctggcactgatggcgaaaacgggcgaaatgggttacccgtcagccctgactgcgccggtgtggggcttctacgacgtctcctttaaaggtgaatcgttccgcttccagcgcccgtacggttcctacgttatggaaaatgtgctgttcaaaatctccttcccggcggagttccactcccagacggcagttgaagcagcgatgacgctctatgaacagatgcaggcagcaggcaaaacggcggcggatatcgaaaaagtgaccattcgcacccacgaagcctgtattcgcatcatcgacaaaaaagggccgctcaataacccggcagaccgcgatcactgcattcagtacatggtggcgatcccgctgctattcgggcgcttaacggcggcagattacgaggacaacgttgcgcaagataaacgcattgacgccctgcgcgagaagatcaattgctttgaagatccggcatttaccgctgactaccacgacccggaaaaacgcgccatcgccaatgccattacccttgagttcaccgacggcacacgatttgaagaagtggtggtggagtaccccattggtcatgctcgccgccgtcaggatggtattccgaaactggtcgataaattcaaaatcaatctcgcgcgccagttcccgactcgccaacagcagcgcattctggaggtttctctcgacagagctcgcctggaacagatgccggtcaatgagtatctcgacctgtacgtcatttaagtaaacggcggtaaggcgtaagttcaacaggagagcattatgtcttttagcgaattttatcagcgttcgattaacgaaccggagcagttctgggccgagcaggcccggcgtattgactggcagacgccctttacgcaaacgctcgatcacagcaatccgccgtttgcccgttggttttgtgaaggccgaaccaacttgtgccacaacgccatcgaccgctggctggagaaacagccagaggcgctggcgctgattgccgtctcttcggaaacagaagaagagcgcacctttacctttcgtcagctgcatgacgaagtgaacgcggtggcctcaatgttgcgttcattgggtgtgcagcgcggcgatcgggtgctggtgtatatgccgatgattgccgaagcgcatattactctgctggcctgcgcgcgcattggcgctattcactcggtggtgtttggtggatttgcctcgcacagcgtggcggcgcgaattgatgacgctaaaccggtgctgattgtctcggctgatgccggagcgcgcggtggcaaaatcattccctataaaaaattgctcgacgatgcgataagtcaggcgcagcaccagccacgccatgttttgctggtggatcgcgggctggcgaaaatggcgcgcgtcagcgggcgggatgtcgatttcgcgtcgttgcgccatcaacacatcggcgcgcgggtaccggtggcgtggctggaatccaacgaaacctcctgcattctctacacttccggcacgaccggcaaacctaaaggcgtgcagcgtgacgtcggcggatatgcggtggcgctggcgacctcgatggacaccatttttggcggcaaagcgggcagcgtgttcttttgcgcatcggatatcggctgggtggtggggcattcgtatatcgtttacgcgccgctgctggcggggatggcgactatcgtttacgaaggattgccgacctggccggactgcggcgtgtggtggacaatcgtcgagaaatatcaggttagccggatgttctcagcgccgaccgccattcgcgtgctgaaaaaattccctaccgctgaaattcgcaaacacgatctctcgtcgctggaagtgctctatctggctggagaaccgctggacgagccgaccgccagttgggtgagcaatacgctggatgtgccggtcatcgacaactactggcagaccgaatccggctggccgattatggcgattgctcgcggtctggacgacaggccgacgcgtctgggaagccccggtgtgccgatgtatggctataacgtgcagttgcttaatgaagtcaccggcgaaccgtgtggcgtcaacgagaaagggatgctggtggtggaagggccgctgccgccggggtgtattcagaccatctggggcgacgacggccgctttgtgaagacttactggtcgctgttttcccgcccggtgtacgccacctttgactggggcatccgtgacgctgacggttatcactttattctcgggcgcactgacgatgtaattaacgttgccgggcatcggctggggacgcgcgagattgaagagagtatctccagccatccgggcgttgccgaagtggcggtggttggggtgaaagatgcgctgaaagggcaggtggcggtggcgtttgtcattccgaaagagagcgacagtctggaagatcgtgatgtggcgcactcgcaagagaaggcgattatggcgctggtggacagccagattggcaactttggccgcccggcgcacgtctggtttgtctcgcaattgccaaaaacgcgatccggaaaaatgctgcgccgcacgatccaggcgatttgcgaaggacgcgatcctggagatctgacgaccattgatgatcctgcgtcgttggatcagatccgccaggcgatggaagagtaggttattgtcggatgcgtcgcgcggtgcatccggcactgtgtgccgatgcctgatgcgacgctgacgcgttttatcatgcctacggacctgaaccgtaggtcggataaggcgctcgcgtcgcatccgacaccatgctcagatgcctgatgcgacgctgacgcgtcttatcaggcctacccactgtttttacaccgataatttttcccccacctttttgcactcattcatataaaaaatatatttccccacgaaaacgattgctttttatcttcagatgaatagaatgcggcggattttttgggtttcaaacagcaaaaagggggaatttcgtgtcgcaagataacaactttagccaggggccagtcccgcagtcggcgcggaaaggggtattggcattgacgttcgtcatgctgggattaaccttcttttccgccagtatgtggaccggcggcactctcggaaccggtcttagctatcatgatttcttcctcgcagttctcatcggtaatcttctcctcggtatttacacttcatttctcggttacattggcgcaaaaaccggcctgaccactcatcttcttgctcgcttctcgtttggtgttaaaggctcatggctgccttcactgctactgggcggaactcaggttggctggtttggcgtcggtgtggcgatgtttgccattccggtgggtaaggcaaccgggctggatattaatttgctgattgccgtttccggtttactgatgaccgtcaccgtcttttttggcatttcggcgctgacggttctttcggtgattgcggttccggctatcgcctgcctgggcggttattccgtgtggctggctgttaacggcatgggcggcctggacgcattaaaagcggtcgttcccgcacaaccgttagatttcaatgtcgcgctggcgctggttgtggggtcatttatcagtgcgggtacgctcaccgctgactttgtccggtttggtcgcaatgccaaactggcggtgctggtggcgatggtggcctttttcctcggcaactcgttgatgtttattttcggtgcagcgggcgctgcggcactgggcatggcggatatctctgatgtgatgattgctcagggcctgctgctgcctgcgattgtggtgctggggctgaatatctggaccaccaacgataacgcactctatgcgtcgggtttaggtttcgccaacattaccgggatgtcgagcaaaaccctttcggtaatcaacggtattatcggtacggtctgcgcattatggctgtataacaattttgtcggctggttgaccttcctttcggcagctattcctccagtgggtggcgtgatcatcgccgactatctgatgaaccgtcgccgctatgagcactttgcgaccacgcgtatgatgagtgtcaattgggtggcgattctggcggtcgccttggggattgctgcaggccactggttaccgggaattgttccggtcaacgcggtattaggtggcgcgctgagctatctgatccttaacccgattttgaatcgtaaaacgacagcagcaatgacgcatgtggaggctaacagtgtcgaataacgctttacaaacaattattaacgcccggttaccaggcgaagaggggctgtggcagattcatctgcaggacggaaaaatcagcgccattgatgcgcaatccggcgtgatgcccataactgaaaacagcctggatgccgaacaaggtttagttataccgccgtttgtggagccacatattcacctggacaccacgcaaaccgccggacaaccgaactggaatcagtccggcacgctgtttgaaggcattgaacgctgggccgagcgcaaagcgttattaacccatgacgatgtgaaacaacgcgcatggcaaacgctgaaatggcagattgccaacggcattcagcatgtgcgtacccatgtcgatgtttcggatgcaacgctaactgcgctgaaagcaatgctggaagtgaagcaggaagtcgcgccgtggattgatctgcaaatcgtcgccttccctcaggaagggattttgtcgtatcccaacggtgaagcgttgctggaagaggcgttacgcttaggggcagatgtagtgggggcgattccgcattttgaatttacccgtgaatacggcgtggagtcgctgcataaaaccttcgccctggcgcaaaaatacgaccgtctcatcgacgttcactgtgatgagatcgatgacgagcagtcgcgctttgtcgaaaccgttgctgccctggcgcaccatgaaggcatgggcgcgcgagtcaccgccagccacaccacggcaatgcactcctataacggggcgtatacctcacgcctgttccgcttgctgaaaatgtccggtattaactttgtcgccaacccgctggtcaatattcatctgcaaggacgtttcgatacgtatccaaaacgtcgcggcatcacgcgcgttaaagagatgctggagtccggcattaacgtctgctttggtcacgatgatgtcttcgatccgtggtatccgctgggaacggcgaatatgctgcaagtgctgcatatggggctgcatgtttgccagttgatgggctacgggcagattaacgatggcctgaatttaatcacccaccacagcgcaaggacgttgaatttgcaggattacggcattgccgccggaaacagcgccaacctgattatcctgccggctgaaaatgggtttgatgcgctgcgccgtcaggttccggtacgttattcggtacgtggcggcaaggtgattgccagcacacaaccggcacaaaccaccgtatatctggagcagccagaagccatcgattacaaacgttgaacgactgggttacagcgagcttagtttatgccggatgcggcgtgaacgccttatccggcctacgtagagcactgaactcgtaggcctgataagcgtagcgcatcaggcaattccagccgctgatctgtgtcagcggctaccgtgattcattcccgccaacaaccgcgcattcctccaacgccatgtgcaaaaatgccttcgcagcggctgtctgccagctgtagtttatgccggatgcggcgtgaacgccttatccggcctacgtagagcactgaactcgtaggcctgataagcgtagcgcatcaggcaattccagccgcagacctgtgtcagcggctaccgtgattcatttccgccaacaaccgcgcatttatccaacgccatgtgcaaaaatgccttcgcggcggctgtctgccagctatttttccgccgcaacaaaaccgccgttctctccagtagtggcggggcaagagaaatagctttaagcccgtcatgttgtgtggcaatcgctgctggtaacaatgtggaaagggaagtgcggcgaatcagctccagaaccgcgctaattgagttcgcctcaatgaccacctgtggatgtagccccgctttctcgcagtagtggtcaatttgctctctggtggcaaattccgcgctgagcaggaccagtttttcatcatgcaagcgactcaacgccacctgttcatggacggccagcggatgatgttgcgccacgactaacgctaaactttctgtcagtaaaggaattgcctccagctccggcgaatgcacaggcgcgaaggcaatcccaacgtccaactcgtcgcggcaaagcatatcctcgattttctcctgcgacatttcctgtagctggagcgtgatgctgggatagcgcgcatagaaatccgccattaaggggccgataaagtagctcgtaaaggtgggggtgacggcgatacgcagcgatcctcgcgtcagatcggcaacatcatgaatcgcccgtttacccgcccccagttcctgtaacgcccggctggcgtactgtcgccagacttctcctgcatcagtgagacgaatcgttcgcccgctacggtcaaacagcggcacgcctaaactctcctctaactggcgaatctgctgggaaagcgcaggttgggagacgtgcaacgcactggcggcacgggtgaagctgccatgttcagccacggcaagaaaataattgatatgtcgagagagcattcgcaacctataagtaaatccaatggaactcatcataaatgagacttttaccttatgacaatcggcgagtagtctgcctctcattccagagacagacagaggttaacggtgaaagagattattgatggattccttaaattccagcgcgaggcatttccgaagcgggaagccttgtttaaacagctggcgacacagcaaagcccgcgcacactttttatctcctgctccgacagccgtctggtccctgagctggtgacgcaacgtgagcctggcgatctgttcgttattcgcaacgcgggcaatatcgtcccttcctacgggccggaacccggtggcgtttctgcttcggtggagtatgccgtcgctgcgcttcgggtatctgacattgtgatttgtggtcattccaactgtggcgcgatgaccgccattgccagctgtcagtgcatggaccatatgcctgccgtctcccactggctgcgttatgccgattcagcccgcgtcgttaatgaggcgcgcccgcattccgatttaccgtcaaaagctgcggcgatggtacgtgaaaacgtcattgctcagttggctaatttgcaaactcatccatcggtgcgcctggcgctcgaagaggggcggatcgccctgcacggctgggtctacgacattgaaagcggcagcatcgcagcttttgacggcgcaacccgccagtttgtgccactggccgctaatcctcgcgtttgtgccataccgctacgccaaccgaccgcagcgtaaccttatttttaaaccatcaggagttccaccatgattcagtcacaaattaaccgcaatattcgtcttgatcttgccgatgccattttgctcagcaaagctaaaaaagatctctcatttgccgagattgccgacggcaccggtctggcagaagcctttgtaaccgcggctttgctgggtcagcaggcgcttcctgccgacgccgcccgcctggtcggggcgaagctggatctcgacgaagactccattctactgttgcagatgattccactgcgtggctgcattgatgaccgtattccaactgacccaacgatgtatcgtttctatgaaatgttgcaggtgtacggtacaaccctgaaagcgttggttcatgagaaatttggcgatggcattattagcgcgattaacttcaaactcgacgttaagaaagtggcggacccggaaggtggcgaacgtgcggtcatcaccttagatggtaaatatctgccgaccaaaccgttctgacagccatgcgcaaccatcaaaagacgttcacgatgctgctggtactggtgctgattggtcttaatatgcgaccactgctcacctccgtcgggccactgctaccgcaattgcgccaggcgagcggaatgagctttagcgtggctgccctgttgaccgctctgccggtggttaccatgggcgggctggcgctggccggaagctggcttcatcagcatgtcagcgaacgtcgcagtgtcgccatcagtctgttgctgattgccgtcggtgcattgatgcgtgagctttacccgcaaagtgcgctgctgcttagcagcgcactgcttggtggggtggggatcggcatcattcaggcggtgatgccttcggtgattaaacggcggtttcagcagcgcacgccactggtgatggggctgtggtccgcggctctgatgggcggcggtgggcttggtgccgccataacgccctggttagttcaacatagcgaaacctggtatcaaacactcgcctggtgggcgctgcctgccgttgttgcgctctttgcctggtggtggcaaagcgcccgcgaggtcgcctcttcccacaagacaacaaccactccggttcgcgtggtattcactccccgcgcgtggacgctgggtgtttacttcggtctgattaacggcggttacgccagcctgattgcctggttacccgctttctatattgagattggtgccagcgcgcagtacagcggttccttactggcattgatgacgcttgggcaagccgcaggagctttgctgatgcctgctatggctcgccatcaggatcggcgcaaactgttaatgctggcgctggtgttacaactggtggggttctgcggctttatctggctgccgatgcaattgccggtattgtgggcgatggtgtgtgggttaggtctgggcggcgcgtttccgctctgtttgctgctggcgctcgatcactctgtgcaaccggctattgctggcaagctggtggcgtttatgcagggaatcggttttatcatcgccgggcttgccccgtggttttctggcgtgctgcgtagtatcagcggcaattacctgatggactgggcatttcatgcgctgtgcgtcgttgggctgatgatcataaccctgcgttttgcaccagtacgttttccgcagctgtgggtcaaagaggcatgatgcgacgcttgttcctgcgctttgttcatgccggatgcggctaatgtagatcgctgaacttgtaggcctgataagcgcagcgtatcaggcaatttttataatttaaactgacgattcaactttataatctttgaaataatagtgcttatcccggtcgtttatttcgcgaataacccgacaaggaacgccagccgccacgacgtttggtggaatgtcttttgtgacgatactacccgcgccaataacagaattatccccgatggtgacgcctggattaataaccacatgacttccgatccagacgttattgccaatcgttatcggaaaagagtacatctcgccgttttttctcaattcatggtgtacagggtgtcccgtaacggaaagagtaacgttgggtgcaatcagtacgttatcaccgattgttaccgtgtagtcatcgacaatggttaaattgaaatttgcataaaaattgcggcctatatggatgttggaaccgtaagagaaatagacaggcggttctacccaggcgttttcccctaccgtggcaaacatttctttaatcaggctttctcttttttcaacttctgatggatgcgagtgattaaactcatacattaacgttttcccacgaagtcttttttccggtaagccttcgcacatatcggtaaatagcttgcctgctcttattctttcggtcattggcatgttcaatgcgatcactccgttatgatatgttggtcggataaggcgctcgcgccgcatccgacattgattgcttaagcgacttcattcacctgacgacgcagcagggaaagcgggccggggccgctaagcgtgaacacggaaattaaggtgaagcccagcgccaccagacccagcaccagataagcgccctggaaaccgatgctttcatacatattgcccgccagtacagacataaaaatcatcgccagttgcttaaagaagcagaaacagaccagataaatcgtcgctgaaaaacgcacttcaaactggctggtaatatatttaaagcagcccaccagcaggaacggtacttcaaacatatgcagcgttttcagaataaccacttccagcgctgaggtggcgaacgatgagccaataatacgtacagacataatagtgccagccagcagcagggcgtttttcccaccgatgcgattaatgatcagtggcgcaaagaacataatcgaggcgttaagtaattcgcccattgtcgttacgtagccaaatacccgcgtaccctgttcaccggtagcaaagaacgaagtaaagaaattagcaaactgttggtcaaaaacatcgtaggtgcaggaaacgccaataacatacagtgacaaaaaccacagttttggctgtctgaacagttccagtgccagcttaaggctaaatgccgaatggttggcacctaccgcattggcaaccgtggcagaagagggcgcatccgttttggcgaaaaagagtaaaacggcgaggatgagtgcacagccagagcccagccagaaaacaaactgattattgatggtgaacatgatgccgacaatcgaggcacacagcgcccagccaacacagccaaacatccgcgcgcgaccaaattcgaaattactgcgacggctgactttctcaataaatgcctctactgctggcgcaccggcgttaaaacaaaagcctagataaataccaccaacaatcgatcctactaaaatgttgtattgtaacagtggcccgaagataaaaataaagaacggcgcaaacatcactaacatgccggtaataatccacagcaggtatttgcgcagcccgagtttgtcagaaagcagaccaaacagcggttggaataatagcgagaacagagaaatagcggcaaaaataatacccgtatcacttttgctgatatggttgatgtcatgtagccaaatcgggaaaaacgggaagtaggctcccatgataaaaaagtaaaagaaaaagaataaaccgaacatccaaaagtttgtgttttttaaatagtacataatggatttccttacgcgaaatacgggcagacatggcctgcccggttattattatttttgacaccagaccaactggtaatggtagcgaccggcgctcagctggaattccgccgatactgacgggctccaggagtcgtcgccaccaatccccatatggaaaccgtcgatattcagccatgtgccttcttccgcgtgcagcagatggcgatggctggtttccatcagttgctgttgactgtagcggctgatgttgaactggaagtcgccgcgccactggtgtgggccataattcaattcgcgcgtcccgcagcgcagaccgttttcgctcgggaagacgtacggggtatacatgtctgacaatggcagatcccagcggtcaaaacaggcggcagtaaggcggtcgggatagttttcttgcggccctaatccgagccagtttacccgctctgctacctgcgccagctggcagttcaggccaatccgcgccggatgcggtgtatcgctcgccacttcaacatcaacggtaatcgccatttgaccactaccatcaatccggtaggttttccggctgataaataaggttttcccctgatgctgccacgcgtgagcggtcgtaatcagcaccgcatcagcaagtgtatctgccgtgcactgcaacaacgctgcttcggcctggtaatggcccgccgccttccagcgttcgacccaggcgttagggtcaatgcgggtcgcttcacttacgccaatgtcgttatccagcggtgcacgggtgaactgatcgcgcagcggcgtcagcagttgttttttatcgccaatccacatctgtgaaagaaagcctgactggcggttaaattgccaacgcttattacccagctcgatgcaaaaatccatttcgctggtggtcagatgcgggatggcgtgggacgcggcggggagcgtcacactgaggttttccgccagacgccactgctgccaggcgctgatgtgcccggcttctgaccatgcggtcgcgttcggttgcactacgcgtactgtgagccagagttgcccggcgctctccggctgcggtagttcaggcagttcaatcaactgtttaccttgtggagcgacatccagaggcacttcaccgcttgccagcggcttaccatccagcgccaccatccagtgcaggagctcgttatcgctatgacggaacaggtattcgctggtcacttcgatggtttgcccggataaacggaactggaaaaactgctgctggtgttttgcttccgtcagcgctggatgcggcgtgcggtcggcaaagaccagaccgttcatacagaactggcgatcgttcggcgtatcgccaaaatcaccgccgtaagccgaccacgggttgccgttttcatcatatttaatcagcgactgatccacccagtcccagacgaagccgccctgtaaacggggatactgacgaaacgcctgccagtatttagcgaaaccgccaagactgttacccatcgcgtgggcgtattcgcaaaggatcagcgggcgcgtctctccaggtagcgaaagccattttttgatggaccatttcggcacagccgggaagggctggtcttcatccacgcgcgcgtacatcgggcaaataatatcggtggccgtggtgtcggctccgccgccttcatactgcaccgggcgggaaggatcgacagatttgatccagcgatacagcgcgtcgtgattagcgccgtggcctgattcattccccagcgaccagatgatcacactcgggtgattacgatcgcgctgcaccattcgcgttacgcgttcgctcatcgccggtagccagcgcggatcatcggtcagacgattcattggcaccatgccgtgggtttcaatattggcttcatccaccacatacaggccgtagcggtcgcacagcgtgtaccacagcggatggttcggataatgcgaacagcgcacggcgttaaagttgttctgcttcatcagcaggatatcctgcaccatcgtctgctcatccatgacctgaccatgcagaggatgatgctcgtgacggttaacgcctcgaatcagcaacggcttgccgttcagcagcagcagaccattttcaatccgcacctcgcggaaaccgacatcgcaggcttctgcttcaatcagcgtgccgtcggcggtgtgcagttcaaccaccgcacgatagagattcgggatttcggcgctccacagtttcgggttttcgacgttcagacgtagtgtgacgcgatcggcataaccaccacgctcatcgataatttcaccgccgaaaggcgcggtgccgctggcgacctgcgtttcaccctgccataaagaaactgttacccgtaggtagtcacgcaactcgccgcacatctgaacttcagcctccagtacagcgcggctgaaatcatcattaaagcgagtggcaacatggaaatcgctgatttgtgtagtcggtttatgcagcaacgagacgtcacggaaaatgccgctcatccgccacatatcctgatcttccagataactgccgtcactccagcgcagcaccatcaccgcgaggcggttttctccggcgcgtaaaaatgcgctcaggtcaaattcagacggcaaacgactgtcctggccgtaaccgacccagcgcccgttgcaccacagatgaaacgccgagttaacgccatcaaaaataattcgcgtctggccttcctgtagccagctttcatcaacattaaatgtgagcgagtaacaacccgtcggattctccgtgggaacaaacggcggattgaccgtaatgggataggtcacgttggtgtagatgggcgcatcgtaaccgtgcatctgccagtttgaggggacgacgacagtatcggcctcaggaagatcgcactccagccagctttccggcaccgcttctggtgccggaaaccaggcaaagcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaatccgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtcaacgtaaatgcatgccgcttcgccttccggccaccagaatagcctgcgattcaaccccttcttcgatctgttttgctacccgttgtagcgccggaagatgcttttccgctgcctgttcaatggtcattgcgctcgccatatacaccagattcagacagccaatcacccgttgttcactgcgcagcggtacggcgatagaggcgatcttctcctcctgatcccagccgcggtagttctgtccgtaaccctctttgcgcgcgcgcgccagaatggcttccagctttaacggttcccgtgccagttgatagtcatcaccggggcgggaggctaacatttcgattaattccttgcggtcttgttccgggcaaaaggccagccaggtcaggcccgaggcggttttcagaagcggcaaacgtcgcccgaccattgcccggtgaaaggataagcggctgaaacggtgagtggtttcgcgtaccaccattgcatcaacatccagcgtggacacatctgtcggccataccacttcgcgcaacagatcgcccagcagtggggccgccagtgcagaaatccactgttcgtcacgaaatccttcgcttaattgccgcactttgatggtcagtcgaaaactatcatcggaggggctacggcggacatatccctcttcctgcagcgtctccagcagtcgccgcacagtggtgcgatgcaggccgctgagttccgccagcagcccgacgctggcaccgccatcaagtttatttaacatatttaataacattagaccgcgggttaagccgcgcacggttttgtattccgtctgctcattgttctgcatattaattgacatttctatagttaaaacaacgtggtgcacctggtgcacattcgggcatgttttgattgtagccgaaaacacccttcctatactgagcgcacaataaaaaatcatttacatgtttttaacaaaataagttgcgctgtactgtgcgcgcaacgacattttgtccgagtcgtgaggtactgaaatggcaatacaacaccctgacatccagcctgctgttaaccatagcgttcaggtggcgatcgctggtgccggcccggttgggctgatgatggcgaactatctcggccagatgggcattgacgtgctggtggtggagaaactcgataagttgatcgactacccgcgtgcgattggtattgatgacgaggcgctgcgcaccatgcagtcggtcggcctggtcgatgatgttctgccgcacactacgccgtggcacgcgatgcgttttctcaccccgaaaggccgctgttttgctgatattcagccaatgaccgatgaatttggctggccgcgccgtaacgcctttattcagccgcaggtcgatgcggtgatgctggaaggggtgtcgcgttttccgaatgtgcgctgcttgttttcccgcgagctggaggccttcagtcagcaagatgacgaagtgaccttgcacctgaaaacggcagaagggcagcgggaaatagtcaaagcccagtggctggtagcctgtgacggtggagcaagttttgtccgtcgcactctgaatgtgccgtttgaaggtaaaactgcgccaaatcagtggattgtggtagatatcgccaacgatccgttaagtacgccgcatatctatttgtgttgcgatccggtgcgcccgtatgtttctgccgcgctgcctcatgcggtacgtcgctttgaatttatggtgatgccgggagaaaccgaagagcagctgcgtgagccgcaaaatatgcgcaagctgttaagcaaagtgctgcctaatccggacaatgttgaattgattcgccagcgtgtctacacccacaacgcgcgactggcgcaacgtttccgtattgatcgcgtactgctggcgggcgatgccgcgcacatcatgccggtatggcaggggcagggctataacagtggtatgcgcgacgcctttaacctcgcatggaaactggcgttggttatccaggggaaagcccgcgatgcgctgctcgatacctatcaacaagaacgtcgcgatcacgccaaagcgatgattgacctgtccgtgacggcgggcaacgtgctggctccgccgaaacgctggcagggtacgttacgtgacggcgtttcctggctgttgaattatctgccgccagtaaaacgctacttcctcgaaatgcgcttcaagccgatgccgcaatattacggcggtgcgctgatgcgtgagggcgaagcgaagcactctccggtcggcaagatgtttattcagccgaaagtcacgctggaaaacggcgacgtgacgctgctcgataacgcgatcggcgcgaacttcgcggtaattggctggggatgcaatccactgtgggggatgagcgacgagcaaatccagcagtggcgcgcgttgggcacacgcttcattcaggtggtgccggaagtgcaaattcataccgcacaggataaccacgacggcgtactacgcgtgggcgatacgcaaggtcgcctgcgtagctggttcgcgcaacacaatgcttcgctggtggtgatgcgcccggatcgctttgttgccgccaccgccattccgcaaaccctgggcaagaccctgaataaactggcgtcggtgatgacgctgacccgccctgatgccgacgtttctgtcgaaaaggtagcctgatatgcacgcttatcttcactgtctttcccactcgccgctggtggggtatgtcgacccggcgcaagaggtgctcgatgaggtcaatggcgtgattgccagcgcccgcgagcgtattgcggcattctcccctgaactggtggtgctgtttgcgccagatcactacaacggctttttctatgacgtgatgccaccgttctgtttaggcgttggagcgacggcaattggtgatttcggcagtgcggcaggagagctgcccgtgcctgtggagctggcggaggcctgtgcgcatgccgtcatgaagagcgggatcgatcttgccgtttcttactgtatgcaggtggaccacgggttcgcccagccgctggagttcctgctcggtgggctggataaggtgccagttctgcctgtgttcatcaacggtgtcgccacgccgctgcccggtttccagcgtacccgcatgttgggtgaagccattggacgtttcaccagcactctcaataaacgcgtgctgttcctgggttccggtgggctttcccatcagccgccggtgcccgaactggcgaaagccgatgcccatatgcgcgaccgtctgttggggagcgggaaagatttacccgccagtgagcgcgaattgcgtcagcaacgggtgattagcgccgctgagaagtttgttgaggatcagagaacgctgcatccgctcaacccgatttgggataaccagttcatgactttgctggagcagggacgcatacaggaactggatgccgtcagtaacgaagagctttccgccattgccggaaagtcgacacatgaaatcaaaacctgggtcgccgcttttgccgctatttctgcgtttggcaactggcgtagcgaagggcgttattaccgcccaatcccggagtggattgccggatttggctcgttaagcgccagaacagagaactgaatatgcaggagaagatgatgagttatcagccacaaaccgaagccgccaccagccgttttctgaatgtagaagaagcgggtaaaacgctgcgcatccattttaatgactgcggacaaggcgacgaaaccgttgtcctgctgcatggttccggcccgggtgctactggctgggcgaacttcagccgcaatatcgatccgctggtagaggcgggctatcgggtgatcctgctggattgtccgggttggggcaagagcgattcggtcgttaatagtggttcgcgatcggatcttaatgcacgaatcctgaaaagcgtggtggatcaactggatatcgccaaaatccacctgctgggcaactcgatggggggccatagttctgtggcgttcacccttaaatggccggagcgcgtcggcaaactggtgctgatgggcggcggtacgggcggcatgagtttgtttacgccgatgccaaccgaaggtattaagcgactgaatcagctttatcgtcagccgactatcgaaaacctgaagctgatgatggatatcttcgtttttgataccagcgatttgaccgacgccctgtttgaagcgcgcctgaataatatgctgtcgcgccgcgatcacctggaaaacttcgttaagagcctggaagctaatccgaaacagttcccggattttggcccacgtctggcggaaatcaaagcgcaaaccctgattgtctgggggcgcaacgaccgctttgtgccgatggatgcgggtctgcgtctgctgtccggcattgccggttctgaactgcatatcttccgcgactgtggtcactgggcgcagtgggaacatgccgacgctttcaatcaactggtgctgaatttcctcgcacgcccttaaggaatggtcatgacgaagcatactcttgagcaactggcggcggatttacgccgcgccgcagagcagggcgaagcgattgcaccgctgcgcgatctgattggtatcgataacgctgaagcggcttacgccattcagcacataaatgtgcaacatgacgttgcgcaggggcgtcgcgtggtagggcgtaaagtgggcctgacacatccgaaagtgcaacaacaactgggcgttgatcaaccggattttgggacgttatttgccgacatgtgttatggcgataacgaaatcattcctttttcccgtgttctgcaaccccgcattgaagcggagatcgcactggtgttgaaccgcgatttgcccgcaaccgatatcaccttcgacgaattgtataacgccattgaatgggtacttccggcgctggaagtggtggggagccgcattcgcgactggtcgattcagtttgtcgataccgtggcagataacgcctcctgtggggtgtatgtcatcggcggtccggcgcaacgtccggcggggttagacctgaaaaactgcgccatgaagatgacgcgtaataacgaagaggtttctagcgggcgcggcagcgaatgcctgggacatccgcttaatgcggccgtctggctggcacgcaaaatggccagtctgggtgaaccgctgcgcaccggagatatcattcttaccggggcattaggtccgatggtggcggtgaatgcgggcgatcgttttgaagcccatattgaaggcataggttcagttgctgcgacattttcaagcgcagccccaaaaggaagtctgtcatgagtaagcgtaaagtcgccattatcggttctggcaacattggtaccgatctgatgattaaaattttgcgtcacggtcagcatctggagatggcggtgatggttggcattgatcctcagtccgacggtctggcgcgcgccagacgtatgggcgtcgccaccacccatgaaggggtgatcggactgatgaacatgcctgaatttgctgatatcgacattgtatttgatgcgaccagcgccggtgctcatgtgaaaaacgatgccgctttacgcgaagcgaaaccggatattcgcttaattgacctgacgcctgctgccatcggcccttactgcgtgccggtggttaacctcgaggcgaacgtcgatcaactgaacgtcaacatggtcacctgcggcggccaggccaccattccaatggtggcggcagtttcacgcgtggcgcgtgttcattacgccgaaattatcgcttctatcgccagtaaatctgccggacctggcacgcgtgccaatatcgatgaatttacggaaaccacttcccgagccattgaagtggtgggcggcgcggcaaaagggaaggcgattattgtgcttaacccagcagagccaccgttgatgatgcgtgacacggtgtatgtattgagcgacgaagcttcacaagatgatatcgaagcctcaatcaatgaaatggctgaggcggtgcaggcttacgtaccgggttatcgcctgaaacagcgcgtgcagtttgaagttatcccgcaggataaaccggtcaatttaccgggcgtggggcaattctccggactgaaaacagcggtctggctggaagtcgaaggcgcagcgcattatctgcctgcctatgcgggcaacctcgacattatgacttccagtgcgctggcgacagcggaaaaaatggcccagtcactggcgcgcaaggcaggagaagcggcatgaacggtaaaaaactttatatctcggacgtcacattgcgtgacggtatgcacgccattcgtcatcagtattcgctggaaaacgttcgccagattgccaaagcactggacgatgcccgcgtggattcgattgaagtggcccacggcgacggtttgcaaggttccagctttaactatggtttcggcgcacatagcgaccttgaatggattgaagcggcggcggatgtggtgaagcacgccaaaatcgcgacgttgttgctgccaggaatcggcactattcacgatctgaaaaatgcctggcaggctggcgcgcgggtggttcgtgtggcaacgcactgtaccgaagctgatgtttccgcccagcatattcagtatgcccgcgagctcggaatggacaccgttggttttctgatgatgagccatatgaccacgccggagaatctcgccaagcaggcaaagctgatggaaggctacggtgcgacctgtatttatgtggtggattctggcggtgcgatgaacatgagcgatatccgtgaccgtttccgcgccctgaaagcagagctgaaaccagaaacgcaaactggcatgcacgctcaccataacctgagtcttggcgtggcgaactctatcgcggcggtggaagagggctgcgaccgaatcgacgccagcctcgcgggaatgggcgcgggcgcaggtaacgcaccgctggaagtgtttattgccgccgcggataaactgggctggcagcatgggaccgatctctatgcgttaatggatgccgccgacgacctggtgcgtccgttgcaggatcgaccggtacgagtcgatcgcgaaacgctggcgctgggatacgctggtgtttactcgagcttcctgcgtcactgtgaaacggcggcggcgcgttatggcttaagtgcggtggatattctcgttgagctgggcaaacgccggatggttggcggccaggaggatatgatcgttgacgtggcgctggatctgcgcaacaacaaataatgatgactgccgagaacgtgcattttgtatgcccatcccagcacgactgccggatgcggcgtgaacgccttatccggcctacggatggcgtgagaatttgtaggtctgataagacgcgttagcgtcgcatcaggcatctgcgcacgactgccggatgcggcgtgaacgccttatccggcctacggatggcgcgggaatttgtaggcctgataagacgcgttagcgtcgcatcaggcatctgcgcacgactgccggatgcggcgtgaacgccttatccggcctacgggtggcgcgagaatttgtaggcctgataagacgcgttagcgtcgcatcaggcatctgcgcacgactgccggatgcggcgtaaacgccttatccggcctacggatggcgcgggaatttgtaggcctgataagacgcgttagcgtcgcatcaggcatctgcacacgactgccggatgcgataaacgtcttgtccggcctacatttcgcccgtaggcagtcattaaatagttctgattacgcggctggcaatgtatcagtcgcgattcacctgcactcgcaacgaggttcatcttatgtcgactcgtaccccttcatcatcttcatcccgcctgatgctgaccatcgggctttgttttttggtcgctctgatggaagggctggatcttcaggcggctggcattgcggcgggtggcatcgcccaggctttcgcactcgataaaatgcaaatgggctggatatttagcgccggaatactcggtttgctacccggcgcgttggttggcggaatgctggcggaccgttatggtcgcaagcgcattttgattggctcagttgcgctgtttggtttgttctcactggcaacggcgattgcctgggatttcccctcactggtctttgcgcggctgatgaccggtgtcgggctgggggcggcgttgccgaatcttatcgccctgacgtctgaagccgcgggtccacgttttcgtgggacggcagtgagcctgatgtattgcggtgttcccattggcgcggcgctggcggcgacactgggtttcgcgggggcaaacttagcatggcaaacggtgttttgggtaggtggtgtggtgccgttgattctggtgccgctattaatgcgctggctgccggagtcggcggttttcgctggcgaaaaacagtctgcgccaccactgcgtgccttatttgcgccagaaacggcaaccgcgacgctgctgctgtggttgtgttatttcttcactctgctggtggtctacatgttgatcaactggctaccgctacttttggtggagcaaggattccagccatcgcaggcggcaggggtgatgtttgccctgcaaatgggggcggcaagcgggacgttaatgttgggcgcattgatggataagctgcgtccagtaaccatgtcgctactgatttatagcggcatgttagcttcgctgctggcgcttggaacggtgtcgtcatttaacggtatgttgctggcgggatttgtcgcggggttgtttgcgacaggtgggcaaagcgttttgtatgccctggcaccgttgttttacagttcgcagatccgcgcaacaggtgtgggaacagccgtggcggtagggcgtctgggggctatgagcggtccgttactggccgggaaaatgctggcattaggcactggcacggtcggcgtaatggccgcttctgcaccgggtattcttgttgctgggttggcggtgtttattttgatgagccggagatcacgaatacagccgtgcgccgatgcctgacgtgccttattaggcaggggcgaaagggacttcaccccaatacacctacggcgtttacaggtatactcgctaaaaattattcagcgggtttggaaacaaagatggcaaaacttaccttacaagagcagttgctcaaagcaggattagtcaccagcaaaaaagcggcgaaggtggagagaacggcgaaaaaatcgcgcgttcaggcgcgtgaagctcgggcggcggtagaagaaaataaaaaggcacagcttgagcgtgataaacagcttagcgaacagcaaaaacaagcggcgttggcgaaagaatataaagctcaggtgaagcagcttattgaaatgaaccgaatcaccattgccaatggcgatattggttttaacttcactgacggcaatctgattaagaagatttttgtcgataagctcacacaggcgcagttgattaatggtcgtctggcgattgcccgcttgttggtcgataacaatagcgaaggtgaatacgccattattcccgccagcgttgccgataaaattgctcagcgcgatgccagcagtatagtgttgcacagcgcgctcagcgccgaagagcaggatgaagacgacccgtatgccgacttcaaagtgcctgatgatttgatgtggtaaacatagataagtcgtgcgcagatgcctgatgcgacgctatgcgcgtcttatcaggcctacggtttatgggcgaagtgtagaccggataaggcgttcacgccgcatccggcagtcgtgcgccatgcctgatgcgacgctttgcgcgtcttatcaggcctacggcttacgggcgaagtgtaggccggataaggcgttcacgccgcatccggcagtcgtgctattatcaacgcatattcagtttattggcgtggtaggcaatatgctcgccaataaaactggagacaaaataatagctgtgatcataaccctcgtgataacggattaacgtcttgatattcatctcctggcagatcttttcaagatttggagtccgcagctgttctgcgtaaaaatcatcactcaacccctgatcaaccatgatttccgcaacgcgttgaccttgtgaaataagactcaccgggtcgtaatccaaccaggcatctttattttcagcaagatatgcagcaaaggcttgctgtccccacggcacttgcgatggggagacaatgggcgaaaacgccgagacgctgacatattcatctgggttacgtaacgccagcaccagcgcgcccagcccgcccatagaatgaccagagatagactttttggccgttgccggaaaatgatgcatcactaaatccggcagctcgttgcggatatagtcatacattttgtaatgttcattccacggcgcttgcgtcgcgttcaggtaaaacccggcaccttgcccgagatcgtaacggtcagcatctgcgacatgactgcctcgcggactggtgtccggcgcaacaacaataatgttgtgctcagccgcgtaacgctgcatccccgatttagtaatgaaattctgctcgttgcaggtcaggcctgaaagccagtacagcaccggcaatttttcattcgcggcttttggtgggagatagacgccgacattcatttcacatttcagtgattgggaataatgccgatacatattttgccagccgccaaagctgacatgtttttcaatgagttccatcagtcattatctcagggttaatcccccggacggctgcccggggagagtattaagaacccccgcctgaagtggacggggtaaacctgcgggaaatcagtaacgaattacggttcgaatggatttgccttcatgcatcaggtcgaaggcgtcattaatttcatccaggctcatggtatgcgtgacaaacggttccagatcgatatcacctttcatcgcatcttcaaccatgcccggtaactgggaacgacctttcacgccgccaaacgcggaacctttccatacgcgaccagtgaccaactggaatggacgggtggagatttcctgaccggcaaccgcgaccccgatgatcaccgactgaccccagccgcggtgcgcactttccagcgccgcacgcatcacgttgacgttaccgatgcattcaaaggtatggtcgataccccatttgttgatatccaacaggacatcttttatcggtttgtcgtagtcattcgggttaatgcagtcggtagcaccgaagcgacgcgccagatcgaatttcttcgggttggtatcgatagcgataatccgacccgctttcgcctgacgcgcgccctgaaccactgccagaccaatcgcgccaagaccaaacacggcaacagaatcacctggctggactttagctgtgttgtgtaccgcgccaataccggtggtcacgccacagcccagcaggcagacgtgttcatggtttgcttctggattaatttttgccagagacacttccgcgactacggtgtattcactgaatgtagagcaccccatgtagtgataaagcggctgcccgttgtaagaaaaacgggtggtgccgtctggcatcaggcctttaccctgggtttcgcgaaccgcaacacagaggttagttttgccagaacgacagaactcacactcgccgcactccgcggtgtaaagcgggatcacatggtcgccaggtttgacgctggttacgccttcaccgacttcaaccacaacgccggccccttcgtgaccgagaaccaccgggaatacaccttccgggtcatcgccggagagggtaaatgcgtcggtatggcaaacgccggtatgggtgactttaattagcacttcaccttttttcggtggtgcaacgtcaatttcaacgatttccagcggtttaccgggagcaaatgcaacggcagcacgtgatttcatctctcgctcttcctcaatatggtaatagattcagctatttaagataggcacgaaccagttcaatagtgtcgtcaacggattggctgacttcgcggctgtagcagtcatttcggtcaaacgtttcccggatatggctttcaagcacttctgccatcagcccattagccgcgccccgaacggcagcgatctgttggagtatggcacggcattcggcatcaccctccagcgaccgttccagagcatcaatctgcccccgaatacgacgaactcgagtaaggacctttttcttctcttccggagtactgggcatttcgcacctcatcatctgcatgcaatatactataggggggtattctatatgtcaatgcatacccccctatagtatataacactggagaataaaatttatccggtgaatgtggtcggaaaacaaagaggaaaggggggggggctaatcggcagggaaggccgccccggatagcgggcggcagaaggaatcagaatttccaggtcagacgggctgcaagttgcagaccgttaaaatcatcggttggggtgtcgtaccacactttacctgccgtcagcccgagattaagttgctcagtcagcggttgaatacgttgcagactgacgctcttcatgctgccgtagcgtgtttctggcgtccagtcataggtgtaagcacctgttccgcggcttagccatagttgcgtataaccagtgccgcgcgggtcattcagacgcacggaaatcatattgctataactaccacctgcatcgctggagtcataatgggtatagcggtagctggtgatcaccgggccagtatagagtgatacgccgccttgccaggcatcgacttcgacatcatcgtaatatttagtgtagcgataaccggtcgtgaaaagcgtttttggtaacagggccaggttaatatcctgacgaaaatcctggcgggcaaagaccggcgtattatccgcaaaggcaatacccgttcgggttgtcagccagttattccatttataccagaccgcaccctgaccgcgagtggcattgaaatgttcagtttcataatcacgacgcccctgggaaagattaaaaagcagcgttgcgttttcaactttcgccaccagttcagcatacgctaaattacggttgccatgatcgccagaataatcggtaaaatcgtagcccgcggtaatggaagttaacccggcataagcgggcaatgcgctaaaaatggccgccgctaataacgtccgttttatcattttaatctcctgtacggataagttcttgtcggagtgaataagttccggtaggtaaattacgttctacaatcacgcgcgggccaagttgcgtgttcggggaaataattcgcccaggcaaaataataacttgtacgccaaggcgtgaacgctgcccgatataacaacctaatttatcgcatccggtagcgataattccctctggagttcgaacagacacgggctgttcatccagacgatgattactggtacgtacttgtgcgcctaaatatgcctggtttgcaactaccgagtcggcaataaaacattgcggaccaatcgttgcttccgcttcaataaccgcatttttaatctcggtggcaaaaccaatttttacgccattgctgattattgtgccaggacgaataaacgcataattactagactggccccctgaatctccagacaaccaatatcacttaaataagtgatagtcttaatactagtttttagactagtcattggagaacagatgattgatgtcttagggccggagaaacgcagacggcgtaccacacaggaaaagatcgcaattgttcagcagagctttgaaccggggatgacggtctccctcgttgcccggcaacatggtgtagcagccagccagttatttctctggcgtaagcaataccaggaaggaagtcttactgctgtcgccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggagtaagcttagtcagccgttgtctccgggtgtcgcgtgcgcagttgcacgtcattctcagacgaaccgatgactggatggatggccgccgcagtcgtcacactgatgatacggatgtgcttctccgtatacaccatgttatcggagagctgccaacgtatggttatcgtcgggtatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtcactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttgtaatgggttaagtgataacagatgtctggaaatataggggcaaatccaattacctatcaggcagtttgcgccaatcactaccggaccctgaataacggcaccatgacaaatacgggtattcgcgccgataacaacttcacctgcagtttcatcaataattacctggtctgcaatctgaatatttttctctttaacattaagcttcagatagtttttcagttcctgtgacagaaggttgggaataagcggttgacgcttccaccagtgcggaatagcgggtgggtttgtcgcgctgaggttcgcgtccagtaaaaaaggcaataagtccataaataatccagatggcataagctaataatacatacacaacggaaagcggcgctaaaggcaccaacaaccagcaacgatgaaaccaggcgctaaaagcaccaataacacaaactacgccgacccagataagcggaaacattgccaacaccactccatgcggcccggtggtgatgaattcattaaaccaggtagtgagataaatcccaacgccataaagcacaaccaacagcataggaaatatactgaagataccgaagcggctaaataaaagtcttttatgcaggcgcatacagaccgcgtatcccacaatccaacgccgccagcgacgccactcctcacgcgggctgttgcattcctgtgggtatacgatgcagcgattcgcctgccgaatacggtagccgtttgccaccaatgtccaggtgagatcaaggtcttcgactttagtacgatccgagaaaccgaacttacgcaatacatcagtacggaacatcccgcaggcaccgctgataataaacggtgcgccacccaggagctgctgtagcgtgcgcttcataacaatcatcggcaactttacggtcgcgcggatgtgcggtaacagacccgcgcctttcaacgcagtagagggaatgccgcctacggcatcggcaccgcgctcaatttctgccagcatatagcccattccgtcttgatcgggcggaacataggtgtcggcatcacttaaaaaaacctggtcgcaggtggcgtaattgaggccattcatcagcgcaccacctttaccggtatttttttgcgtgacggcaacaaagcggtcgccccatttgcgtttgacttccgccatgaccgcttcggtattgtccgtggagccgtcgttaacgcaaattacccggcaaaaataagggttacgcagtagattatccagtgactgcgccagacacgggccttcgttatacgcaggtataatggcgtcaatacagcctttcttttgactgggtttacgtcttagcgtacttaaaaaccatagcaacattgctatggacatacagataaatatccaggttttcatgcaatttgctcaaagaatcattttatgaattacaaagccttcacccagatcgctattgacctgttgtccgcgaaattgtgcaactgcacgcaggcgatcatgacgcatataatcgcgtcgttcctagcttttatgtttttttaatgcagcaagtttgactgtgaaatattcttctttaacggattcaaaaacctgaggcataaatgaaagccaggtacttggggtttcgtagccgagaatttgcggaatagttcggcaggcaaccattgaagcttgataaacagcaagatgatcctgatggcggtcggcatcatgcatggtatatacccgcatgatttcaacatcagaaggaatttgatttttaatgatgtcttccagggcggaaatcatatcattgagctgtaaatgagcgcgggtgtcagcaaaattaagatgaatagtttggtggcaccctaatatctttagggcgttgcgcgattcttcatggcgatcgattattccatctgtgccagagttgccggtagtcatcaccacggctgcgatataaattcctttttgcgcaagacgagcaagcgatgcgccacagcctaattctatatcgtcaggatgtgcgccaatagcaaggataccctttcttttatttgccgaagaaaggagggctgaatctaaaaccttatccacttaatgacactccattttatttattatactacaagcacaacgatgcactcagagacgtaatctctggcgcagccagatgttaatttataaatgttaaatgttgctaataactgaaaagcaagggctttcagacccgtgggttcgactgggtaatgtttctatgcaattcatatgttaagtgtttgtatgtttggtatgtatagttattttgttttatacattgtatttagatgtgatttagtttgtcaattaattgcatttaaaaaatatgttctgtgaacaagcattgtttatatacattatgtgaatgtaatatgcgagtgattgagaatgatacagtgatatatacaatgcgaatataatagttttattatatgtattgatattgatagaaataatgaagtaataaatctcgtaatgtggttgtttatgcatcactaaaatgaagtgtagtaattttcccaattgttagaacggagtaattgcatatttaatctttccttagccgtttttttgctaagaataaaatcatctgtgcgataacgactaattcttttaatgaatgtttttattcctgaatactgctcccataacaagacaggggagcagacaatcatggcaatttcatcgcgtaacacacttcttgccgcactggcattcatcgcttttcaggcacaggcggtgaacgtcaccgtggcgtatcaaacctcagccgaaccggcgaaagtggctcaggccgacaacacctttgctaaagaaagcggagcaaccgtggactggcgtaagtttgacagcggagccagcatcgtgcgggcgctggcttcaggcgacgtgcaaatcggcaacctcggttccagcccgttagcggttgcagccagccaacaggtgccgattgaagtcttcttgctggcgtcaaaactgggtaactccgaagcgctggtggtaaagaaaactatcagcaaaccggaagatctgattggcaaacgcatcgccgtaccgtttatctccaccacccactacagcctgctggcggcactgaaacactggggcattaaacccgggcaagtggagattgtgaacctgcagccgcccgcgattatcgctgcctggcagcggggagatattgatggtgcttatgtctgggcaccggcggttaacgccctggaaaaagacggcaaggtgttgaccgattctgaacaggtcgggcagtggggcgcgccaacgctggacgtctgggtggtgcgcaaagattttgccgagaaacatcctgaggtcgtgaaagcgttcgctaaaagcgccatcgatgctcagcaaccgtacattgctaacccagacgtgtggctgaaacagccggaaaacatcagcaaactggcgcgtttaagcggcgtgcctgaaggtgacgttccggggctggtgaaggggaatacctatctgacgccgcagcaacaaacggcagaactgaccggaccggtgaacaaagcgatcatcgacaccgcgcagtttttgaaagagcagggcaaggtcccggctgtagcgaatgattacagccagtacgttacctcgcgcttcgtgcaataaaaggaggcgcagatgctgcaaatctctcatctttacgccgattatggcggcaaaccggcactggaagatatcaacctgacgctggaaagcggcgagctactggtggtgctggggccgtccggctgcggtaaaaccaccctgctgaatctgattgccggttttgtgccttatcagcatggcagcattcaactggcgggtaagcgtattgagggaccgggagcagagcgtggcgtagtttttcagaatgaagggctactaccgtggcgcaatgtacaggacaacgtggcgttcggcctgcaattggcaggtatagagaaaatgcagcgactggaaatcgcgcaccagatgctgaaaaaagtggggctggaaggcgcagaaaaacgctacatctggcagctttccggtggtcaacgtcagcgggtggggattgctcgtgcgctggcggcgaatccccagctgttattactcgacgaaccgtttggtgcgctggacgccttcacccgcgaccagatgcaaaccctgctgctgaaactctggcaggagacgggcaagcaggtgctgttgattacccacgatatagaagaagcggtgtttatggcgactgaactggttctgctttcatccggccctggccgtgtgctggagcggctgccgctcaactttgctcgccgctttgttgcgggagagtcgagccgcagcatcaagtccgatccacaattcatcgccatgcgcgaatatgttttaagccgcgtatttgagcaacgggaggcgttctcatgagtgtgctcattaatgaaaaactgcattcgcggcggctgaaatggcgctggccgctctcgcgtcaggtgaccttaagcattggcacgttagcggttttactcaccgtatggtggacggtggcgacgctgcaactgattagcccgctatttttgccgccgccgcaacaggtactggaaaaactactcaccattgccggaccgcaaggctttatggacgccacgctgtggcagcatctggcagccagtctgacgcgcattatgctggcgctatttgcagcggtgttgttcggtattccggtcgggatcgcgatgggacttagccctacggtacgcggcattctggatccgataatcgagctttatcgtccggtgccgccgctggcttatttgccgctgatggtgatctggtttggtattggtgaaacctcgaagatcttactgatctatttagcgatttttgcaccggtggcgatgtcggcgctggcgggggtgaaaagcgtgcagcaggttcgcattcgtgccgcccagtcgctgggtgccagccgtgcgcaggtgctgtggtttgtcattttgcccggtgcgctgccggaaatcctcaccggattacgtattggtctgggggtgggctggtctacgctggtggcggcggagctgattgccgcgacgcgcggtttaggatttatggttcagtcagcgggtgaatttctcgcaactgacgtggtgctggcggggatcgcggtgattgcgattatcgcctttcttttagaactgggtctgcgcgcgttacagcgccgcctgacgccctggcatggagaagtacaatgagtgaacgtctgagcattaccccgctggggccgtatatcggcgcacaaatttcgggtgccgacctgacgcgcccgttaagcgataatcagtttgaacagctttaccatgcggtgctgcgccatcaggtggtgtttctacgcgatcaagctattacgccgcagcagcaacgcgcgctggcccagcgttttggcgaattgcatattcaccctgtttacccgcatgccgaaggggttgacgagatcatcgtgctggatacccataacgataatccgccagataacgacaactggcataccgatgtgacatttattgaaacgccacccgcaggggcgattctggcagctaaagagttaccttcgaccggcggtgatacgctctggaccagcggtattgcggcctatgaggcgctctctgttcccttccgccagctgctgagtgggctgcgtgcggagcatgatttccgtaaatcgttcccggaatacaaataccgcaaaaccgaggaggaacatcaacgctggcgcgaggcggtcgcgaaaaacccgccgttgctacatccggtggtgcgaacgcatccggtgagcggtaaacaggcgctgtttgtgaatgaaggctttactacgcgaattgttgatgtgagcgagaaagagagcgaagccttgttaagttttttgtttgcccatatcaccaaaccggagtttcaggtgcgctggcgctggcaaccaaatgatattgcgatttgggataaccgcgtgacccagcactatgccaatgccgattacctgccacagcgacggataatgcatcgggcgacgatccttggggataaaccgttttatcgggcggggtaatacgagagtggacggtcccctcgcccccttggggagagggttagggtgagggggcgttcaccgtactttcaacaggttaactccccctttctgagaggaaacaaaattaacgcagaatcttcttctcagccaaatccagcgcaaagtagctgaaaatcagatccgcacccgcacgcttaatcgaacctaagctttcgagcacgactttctcttcatctatagcacccgccagcgcggcgaacttaatcatcgcatactcaccgctcacctgatacgcgccaatcggcaattcagtacgttcacgcagctcacgcacgatgtcgaggtacgctccagcaggtttaaccatcaggcagtctgcgccctgggcttcatccagcagtgattcacgaatcgcctcacgacggttcattgggttcatctgatagcttttgcggtcgccttttaatgcgcttccggcagcttcacggaacgggccataaaaggaggaggcgaacttggtcgaatacgacataatcgccgtatctttaaatcccgcagcgtccagcgcctgacgaatcgcctgtacctggccgtccatcgcggcggaaggggcgatgaagtctgcacctgcagcagctgcaaccacggcttgcttgcctaaattttccagagtcgcgtcgttgtcgacgccatgctcgcacagcacaccgcagtgaccgtgagaagtgtattcacagaagcaggtgtctgacataacgatcatttctggcacggtctgcttgcagatgcgcgacatacgcgccaccagtccatcttcccgccaggcatcgctgccggtttcatcggtatggtgagagatgccaaaagtcatcacggaacgaataccggcgttggcgatgcgttcaatttcgcgtgccagatgtttctctggaatgcgcatcacgcctggcatggcttcaacggctttgtagtcgtcaatttcttcttcaacaaagatcggcaacaccaggtcgttaaggctaagtgttgtctcttcaaacatagcgcgcagcgcaggagatttgcgcaggcgacgagggcgttggattaagtctgtcatggtctgcctgatgtttgtggaatcgaggggcatagtatacctgaagcagggtagggatgttttacgaaagttgtcgcgatgttgacaagaagagaatggaagagaggccaggacatctttttaatagaaacagcaataattttatattcactgaaaatatttttaatctttatttatagctgttggttattattttttggagtttggttgcgctgctataaattgaataattaaaactttgttgcatattcataggatatttatctggtttgtgtttgtgatatttattatgcgtatgcttcaaaaacaaaattatctgcaacatgttgaaatactgtgcttttatgaatttgatgcgtgtttttctccataaattatatatgtccacattcggacttaggggaaagaataattgaaccattcgtctgtaacgcagcataatcgttagcgcgaaacataatatgttttctatgcattgataattgatggatcaacttattacgtccctgaggagggatgacaaatgcactcctggaaaaagaaacttgtagtatcacaattagcattggcttgcactctggctatcacctctcaggctaatgcagcaaactatgatacctggacttatatcgataatcccgttacagcacttgattgggatcatatggataaggcaggcactgtagatggcaactatgtaaactatagtggttttgtctattacaacaacaccaatggtgatttcgatcagtcctttaacggcgataccgttaacggcacgatctcaacctattatttgaaccatgattatgcagacagtactgctaatcagcttgatatcagtaattcagtgattcacggttcgattacttctatgctgcctggcggttattatgatcgttttgatgcagatggtaataatctgggtggatatgatttttacactgatgcggttgttgatacacactggcgtgatggtgatgttttcactttgaacattgctaacactactattgatgatgattatgaagctctttacttcactgattcttataaagatggtgatgtaaccaagcacacaaatgagacatttgatacaagtgaaggcgttgctgttaatcttgatgtagaaagtaacatcaatatttccaataactcccgcgttgcaggtattgcattatctcaaggtaatacttacaacgaaacctacactaccgaatctcatacttgggataacaatatctctgtaaaagattccacagtgacttcgggttcaaattatatcctggatagcaatacttatggcaaaactggtcactttggcaattctgatgaaccgagtgattatgctggcccgggtgatgttgcaatgtcctttactgcttcaggttccgactatgcgatgaagaacaatgtattcctcagcaattcaacgctgatgggtgatgttgcctttaccagcacctggaatagtaattttgatccgaatggtcatgattccaacggtgacggggtgaaagataccaacgggggttggactgatgatagcctcaacgttgatgaactaaatctcactctcgataacggaagcaagtgggttggtcaggcaatttataacgttgctgaaacgtcagcaatgtatgatgttgctacaaacagccttactcctgatgcaacatatgaaaacaatgactggaaacgtgttgttgatgacaaggtcttccagagcggtgtatttaacgtagcgttgaataacggttctgaatgggatactacaggtcgttccatcgttgataccttgacagttaataatggttctcaggttaatgtttcggaatctaaattaacttcagatactatcgatttaactaacggttcttcgctgaacattggtgaagatggctacgttgataccgatcatctgactattaactcctacagtactgttgcgttgaccgaatctactgggtggggggctgattgatcctacccacgtaatatggacacaggcctaagcgaggttcttgttttcaaattgttccggactgaggccgccacaccaactgtgccgccgccaccgattgtaatcacattcgatataattaaacaccgttgcccgcattatttcccggctgataaagtgttctccatggatacattccactttcagcgaatgaaagaagctttccacgcaggcattatcgtagcagcaaccttttgcgctcatacttccacgcagattatgccgcttcagttgcgcctgataatctgctgaacagtactggcctccacggtccgtgtgaacgataacgttccggggcctcttacgccgccacagcgccatctgcagggcatcgcaggccagttgcgccgtcatgcgtggcgacattgaccagccaataacggcacgtgaccacaggtcaatgaccactgccagatacagccagccttcatctgtacgtaagtacgtgatgtctcctgcccacttctggttcgggccactggcgtaaaaatcctgctccaacagattttctgacacaggcaggccgtgtgcgcggtagctgaccgggctgaacttccgggaggcctttgccctcagtccctgacggcgcaggcttgccgccacggtttttacgttaaaggggtaaccctgagcacgcagttcatccgtcaggcgtggggcaccgtaacgctgttttgaccgggtaaaagccgcgaggacaacgctgtcgcagtgttggcggaactgctgacgcgtgcttatccttgtccgccgctgacaccacgtataccagccgctgcgggccacccggagcacgcggcacattgctttgatgctgaactcagcctgatgtttttcaataaagacatacttcatttcaggcgcttcgcgaagtatgtcgcggccttttggaggatagccagctcttcatcccgttctgccagctggcgtttgagacgtgcaatctcggtagacatctccagttcacgttcagaagacgtctgctgattttgctgtttactgcgccagttgtagagttgtgattcatacaggctgagttcacgggctgcggcagtaacaccgatgcgttcagcaagcttcagggcttcactgcgaaattcaggcgaatgctgtttacggggttttttactggttgatactgtttttgtcatgtgagtcacctctgactgagagtttactcacttagccgcgtgtccactattgctgggtaagatcagattacaacctgtacgccaatactatcaccgtaactaacggcggtgtattggatgtgaacgttgatcagttcgatactgaagctttccgtactgacaaactggaactgaccagcggcaacatcgctgaccataacggtaacgtagtatctggtgtgttcgatatccatagcagcgattacgttctgaacgctgatctggtgaacgaccgtacctgggatacttccaagtctaactacggttacggtattgttgctatgaactctgatggtcacctgactatcaacggtaacggcgacgtagacaacggtactgaactggataacagctctgtagacaatgttgttgctgcaaccggtaactacaaagttcgtatcgacaacgcaactggcgctggcgctatcgctgattacaaagataaagaaattatctacgtaaacgacgtcaacagcaacgcgaccttctctgctgctaacaaagctgacctgggtgcatacacctatcaggctgaacagcgcggtaacaccgttgttctgcaacagatggagctgaccgactacgctaacatggcgctgagcatcccgtctgcgaacaccaatatctggaacctggaacaagacaccgttggtactcgtctgaccaactctcgtcatggcctggctgataacggcggcgcatgggtaagctacttcggtggtaacttcaacggcgacaacggcaccatcaactatgatcaggatgttaacggcatcatggtcggtgttgataccaaaattgacggtaacaacgctaagtggatcgtcggtgcggctgcaggcttcgctaaaggtgacatgaatgaccgttctggtcaggtggatcaagacagccagactgcctacatctactcttctgctcacttcgcgaacaacgtctttgttgatggtagcttgagctactctcacttcaacaacgacctgtctgcaaccatgagcaacggtacttacgttgacggtagcaccaactccgacgcttggggcttcggtttgaaagccggttacgacttcaaactgggtgatgctggttacgtgactccttacggcagcgtttctggtctgttccagtctggtgatgactaccagctgagcaacgacatgaaagttgacggtcagtcttacgacagcatgcgttatgaactgggtgtagatgcaggttataccttcacctacagcgaagatcaggctctgactccgtacttcaaactggcttacgtctacgacgactctaacaacgataacgatgtgaacggcgattccatcgataacggtactgaagggtctgcggtacgtgttggtctgggtactcagtttagcttcaccaagaacttcagcgcctataccgatgctaactacctcggtggtggtgacgtagatcaagactggtccgcgaacgtgggtgttaaatatacctggtaatattcttcactccgaagaaatactggtaatttaatctaaataatgcccgtcaaggatttgacgggcattactgcaaaggacgcgcaaatgttatctgtagttaaacctcttcaggaatttggtaagctcgataaatgtttgtccagatacggtacgcgcttcgagtttaataatgaaaagcaagttatattttccagtgatgtcaataacgaagatactttcgttattttagagggagttatctctctgcgtagagaagaaaacgtacttatcggtattacccaggctccttatattatggggctggctgatggtttaatgaaaaacgatataccatacaaattaatatcagaaggaaattgtacgggatatcatctaccagccaaacaaaccattacgcttattgaacaaaatcaactctggcgagacgctttttactggttagcctggcaaaatagaattctggaattacgcgacgtgcagctcattgggcataattcctacgaacaaatccgcgcaacattattatcaatgattgactggaatgaagaattgcgatcacgtattggtgtgatgaattatatccatcaacgtacacgcatatcgcgttctgtcgtcgcagaagttctcgctgctttgcgtaaaggcggctatatcgaaatgaataaaggcaaactggtcgctatcaaccgtttgccttcagagtattaatcaggacgcggggataaccaacggtttattcccgcttagctcggtcaccaggtcattgatgccatcgctcatatttttaaagcgcgtcaacggcgaacgagtgaccaccacaaacgcgccaatattcttctgcgggatcatcgccatataggtaatgaaaccgccaccaccgcctgtcttctgaataatccccggacgaccctctttcggggccatatatacccaacctaaaccaagcgcatccgctttgccggggacatccatgccaatcactttcgtaaactgcgcgcgctgataaatcaacgtctgcatgcgatctgcctggttactgcgctgataaaaatcagatgacaaatactgctgcatccagcgcatcatatcgccaggcgtggaatagacgccgccgctgccaattgccgccagcgtgttattgcacggactggcaccgcgctcagcaaccattaaacggcggcactgatccggtgagggggtgtaggtggtgtctttcatccccaatggacgggtaatctgctcttcaaacaactgggtataaggcttgccggacgcattcgccagtgcatctgccagcaggtcgaacgcaaggttagagtacgccgcctgactgcctggcgcggctttcagcttcgccgtagaaaggtatttccagcgttgctcgcgcgttggccagacaaacaccggacgatgtgccgcgccaccgggctgttcacggggcagggcgctggtatgggttgccagattgaccagcgtaatgggcgtcccattgtaggttggcacgcgtgcgcctggcggagcatatttacttagcggatcgtttaacttcacggtcccctggtcgagcaatttcaccagcatctcactggtcattagcttggtgagggaagcaatacgcacgaccgaatccagctgcgggcgaacgttattaccaggtcgcgtttcgccataactgcgaaagacgcgctggttaccgtcgataacaaccagagccatccccgtggcaccgctgccgtaaaaaatatgatcggcataacgatcgacaatatcagaggcaaactccggttcagtgatcggctgcgccgcatggacggaggtcaatgacgccgcacacagcacggcagaaaaaagcagactacgtttcaacggtggtgtccatagattgaatgaaggtaactgagcgtatttatactactcattgatagattgcaaagggcgaattagtgcaataatagtgttaaaaacgtaacggcgcgtaaacacgatctttttcctgctcaccaatgcctgcatttgtgatcctgcgcgtgttaatccgcttatgtaaacaatctttggtttgtgaaatccgtcgaaacaattcttatggtcaggctggcgaactaagcgccttgctatgggtcacaatgggcggtttcatttggctgacgctttgtagcggtcatgcggttaatacacagcagttgttaaaacgataagaagttagcaggagtgcatatgtttaagtcttttttcccaaagccgggaacgttttttctctcggccttcgtttgggcattgattgccgttatcttctggcaagccggtgggggtgactgggtggcgcgtatcaccggcgcttccgggcagatcccgattagcgccgcgcgtttctggtcgttggatttcctgattttttacgcttactacattgtttgcgtaggactttttgcattgttctggtttatctacagcccgcatcgttggcaatactggtcaatactcggtactgcactgatcatcttcgtcacctggtttttggtggaagtcggggtcgccgtcaacgcctggtatgcgccgttctatgatctgattcaaaccgcgctaagttcgccgcataaagtcaccatcgaacaattttaccgcgaagtgggcgtctttctggggattgcgctgatcgctgtggtgatcagtgtgctgaacaacttctttgtcagtcactacgtgttccgctggcgtacagcgatgaacgaatattacatggcgaactggcaacaactgcgtcatatcgaaggggccgcacagcgtgtgcaggaagacaccatgcgttttgcttcaacgctggagaatatgggcgtcagttttatcaacgccatcatgacgttgatcgccttcctgccggtgctggtaacgctctccgcgcatgtgccggagctgccgattatcgggcacattccgtatggtctggtgattgccgcaatcgtctggtcgctgatggggaccggattgctggcagtggtagggatcaaactgccggggctggagtttaaaaaccagcgtgtagaggctgcctaccgtaaagagctggtttatggtgaagacgatgccacgcgcgcgacgccgcctacggtacgcgagctgtttagcgccgtacggaaaaactatttccgcctctattttcactatatgtatttcaacatcgcccgcattctctatttgcaggtcgataacgttttcggtttgttcttgctgtttccgtcaattgttgccggtacgattacgctcggcctgatgacgcagattaccaacgtttttggtcaggttcgcggtgctttccagtacctgattaactcatggaccacactggttgagttgatgtctatctacaaacgtctgcgcagctttgaacatgagctggatggtgacaaaattcaggaagtaacccataccttgagctaaaaaggagaagtaatgtcgcgcgtcaatcctctatcttcgctgtcattgttggcggttctggttttagcggggtgtagtagtcaggctccgcaaccgttgaaaaagggcgaaaaagcgatagatgtagcgagcgtcgtgcggcagaagatgcctgcgagcgtgaaagaccgcgatgcctgggcgaaagatctcgccaccacctttgaaagtcaggggctggcaccgacgctggaaaacgtctgctcggtgctggcggtggcgcagcaggagtcaaattatcaggcagatccggccgttccgggcttaagcaagatcgcctggcaagagattgaccgtcgtgctgaacggatgcacattcctgcttttctggttcataccgcgctaaaaatcaaatcgccaaacggcaaaagttatagcgaacggttagattcggtgcgtacagaaaagcaattgagcgcgatttttgacgatctgatcaacatggtgccaatggggcagacgctgtttggttcgctcaatccggtgcgcaccggtgggccgatgcaggtcagcattgcttttgccgaacagcataccaaagggtatccgtggaaaatggacggtacagtccgtcaggaagtcttcagtcgccgcggcgggttgtggtttggtacttaccatttactgaattatcccgccagttatagcgcaccgatataccgttttgctgattttaacgctggctggtacgccagccgtaatgccgcgtttcagaacgcggtcagtaaggccagcggcgtgaagctggcactggacggtgatttaattcgttacgacagtaaagaacccgggaaaaccgaactggcaacgcgcaaactggctgcaaaactggggatgagcgacagcgaaattcgccgtcagttagagaaaggtgacagcttctcttttgaggagacggcgctgtacaagaaagtttatcaacttgccgaaacgaaaacgggtaaatcactcccccgcgaaatgttgcctggcattcaactggaaagcccgaaaatcacccgcaacctgactacggcctggtttgcgaagcgcgtagacgaacggcgggcgcgttgtatgaaacagtgatcaaacaggaatgtcaggccagataaggcgtttcaggccgcatctgacaatgtaaaacttactggcggcgatgtcgccagtgcagccatagcgccaccactgcaaaaatgaggcagcctactaaaaacgggatcagcccgaaaatggtgccgacacctaaaccaatttccacccgtgggcgacctgtttcctggacctgcattaaacgctcatagacgccgggcgcatgcactaacaggttcagcaattgcgccccagcccaaaagcaaaacagcacaaacaacgcataggcaatgttgccaggcgttgaagaggcattgcgatattttccgctaaacagcgattttgacagggtgaaatcagccataaaaacctccggaagtcatctgcttctcttctggtgtgataccagcggcttatggcaagtctgacaggtcatttagattgtcaatatcagaatcatggtaaattgatgttgggaatattcccgaagcgtgaatcttcgttgtgagtcacaaaatggcaaccttaagttaaatttattaacaattacgaaaatgttgtctacaccacagacggttgttgcagaatatgcaaggatgttgtttttcgttaacggagctgccatgaatctgcctgtaaaaatccgccgtgactggcactactatgcgttcgccattggccttatattcattcttaatggcgtggtggggttactgggatttgaagcaaaaggttggcagacctatgccgtcggtctggtgacgtgggtgattagtttctggctggcggggttgattattcgtcgtcgcgatgaagaaactgaaaacgcccaataagaatattatcgggcgttaaaatattacattgtggttttcaatgcgttatccgcagcgtgacgctccagcgccagttcaatcaaacgtgtgatcagatcggtgtaacccagaccgctggcttgccacagcttcggatacatactgatattagtgaagccaggcagggtgttgatctcgttgatcaccacttcgttctctggggttaaaaacacgtctacacgcgccatgcctgcgcatcccaacgtttgataagcctgaacggcaatcgcccggatcttatcgttgatttctggcgcaatggctgccggaactaccactttcgcgccatcttcgtcaatgtacttggtgtcgtaggcatagaaatcgctggtgagtacgatctctccacaggtgctggcttgcggattgtcgttgcccagaactgcgcattcgatctcacgacctttgatcccttgctcaacgatcactttatgatcgaactcgaacgccagatcgacggcaattgcgtactgttcttcactggttactttgctgacaccaacagaagagccctgattagccggttttacaaacagtggtaaccccagtttagactccacttcggcaaaactaatgttgtgacgattggcgcgcgtcagggtaataaatggcgcaatgttcagcccggcatcgcgtagcagacgtttggtgacatctttgtccatacaggctgctgaagccagaacatcagaacctacaaacggtaaattggcgacccgcagcattccctgcaaggaaccatcttcgcccagcgtaccgtggacaatcgggaaaatgacatccaccgtcggcaacggctgaccgttttgcgcgtcgataagctgatgctcatgtttacctggcacctgcgcaaggctggtcgccgaagggcgcaacgcaatatgggcaggatcgtctgcatttagcagataattgctggcatcgctgacgtgccattgcccttgtttatcaatgcccagcagcacaacgtcgaagcgacttttatcaatggcatcgacaatgttttttgccgattgcagagacacttcatgttccgctgatttaccaccaaaaacgattcctacccgcagtttttccatcttaaaaacctatcccgtctaacacaaagtgcatacattaccacgacaaaacgggggattcgcggccttctgaaagattgttgcaatcttctgctgacaaagcgtgcaacgtactggtgaagaaagtgcgttatctcaaagatgtgcgcaagatcacaaaaatgatgaacgggaagctaatttattcctggcttaaatggccatgcggtgagtttttttctcttaattataagttaacgaagagaatatatttcataacttttatttataataaaggttgataattaaaagcctatattttgtgtgggtaattatttaaataagagaaacgtttcgctggtaatcaaacaaaaaatatttgcgcaaagtatttcctttgtcataaaaataatacttccagacactatgaagttgtgaaacataatgttaacttctccatactttggataaggaaatacagacatgaaaaatctcattgctgagttgttatttaagcttgcccaaaaagaagaagagtcgaaagaactgtgtgcgcaggtagaagctttggagattatcgtcactgcaatgcttcgcaatatggcgcaaaatgaccaacagcggttgattgatcaggtagagggggcgctgtacgaggtaaagcccgatgccagcattcctgacgacgatacggagctgctgcgcgattacgtaaagaagttattgaagcatcctcgtcagtaaaaagttaatcttttcaacagctgtcataaagttgtcacggccgagacttatagtcgctttgtttttattttttaatgtatttgtacatggagaaaataaagtgaaacaaagcactattgcactggcactcttaccgttactgtttacccctgtgacaaaagcccggacaccagaaatgcctgttctggaaaaccgggctgctcagggcgatattactgcacccggcggtgctcgccgtttaacgggtgatcagactgccgctctgcgtgattctcttagcgataaacctgcaaaaaatattattttgctgattggcgatgggatgggggactcggaaattactgccgcacgtaattatgccgaaggtgcgggcggcttttttaaaggtatagatgccttaccgcttaccgggcaatacactcactatgcgctgaataaaaaaaccggcaaaccggactacgtcaccgactcggctgcatcagcaaccgcctggtcaaccggtgtcaaaacctataacggcgcgctgggcgtcgatattcacgaaaaagatcacccaacgattctggaaatggcaaaagccgcaggtctggcgaccggtaacgtttctaccgcagagttgcaggatgccacgcccgctgcgctggtggcacatgtgacctcgcgcaaatgctacggtccgagcgcgaccagtgaaaaatgtccgggtaacgctctggaaaaaggcggaaaaggatcgattaccgaacagctgcttaacgctcgtgccgacgttacgcttggcggcggcgcaaaaacctttgctgaaacggcaaccgctggtgaatggcagggaaaaacgctgcgtgaacaggcacaggcgcgtggttatcagttggtgagcgatgctgcctcactgaattcggtgacggaagcgaatcagcaaaaacccctgcttggcctgtttgctgacggcaatatgccagtgcgctggctaggaccgaaagcaacgtaccatggcaatatcgataagcccgcagtcacctgtacgccaaatccgcaacgtaatgacagtgtaccaaccctggcgcagatgaccgacaaagccattgaattgttgagtaaaaatgagaaaggctttttcctgcaagttgaaggtgcgtcaatcgataaacaggatcatgctgcgaatccttgtgggcaaattggcgagacggtcgatctcgatgaagccgtacaacgggcgctggaattcgctaaaaaggagggtaacacgctggtcatagtcaccgctgatcacgcccacgccagccagattgttgcgccggataccaaagctccgggcctcacccaggcgctaaataccaaagatggcgcagtgatggtgatgagttacgggaactccgaagaggattcacaagaacataccggcagtcagttgcgtattgcggcgtatggcccgcatgccgccaatgttgttggactgaccgaccagaccgatctcttctacaccatgaaagccgctctggggctgaaataaaaccgcgcccggcagtgaattttcgctgccgggtggtttttttgctgttagcaaccagacttaatggcagatcacgggcgcatacgctcatggttaaaacatgaagagggatggtgctatgaaaataacattactggttaccttgcttttcggtctggtttttttaaccaccgtcggcgctgccgagagaactttaaccccacaacaacagcgtatgacctcctgtaatcagcaggcgacggcgcaggcgttgaaaggggatgctcgtaagacctacatgagtgattgcctgaagaacagcaagtctgcgcctggcgaaaaaagtttgacgccacagcagcaaaagatgcgcgaatgcaataatcaagcaacacaacaatctctgaaaggtgatgatcgtaataagtttatgagtgcctgcctcaagaaagccgcctgatacctgatagtgctaacgggtgagctacgaaaatggctcacccgaaatatcatacttctgcctttagctccgtctctataatttgggaaaattgtttctgaatgttcccaaaaataatgaatgatgaaaactttttcaaaaaagcggcggcgcacggggaggaacctcctttaactcctcaaaacgaacatcagcggtccgggctgcgcttcgcccgtcgcgtcagactaccccgtgcggttggcctggctggcatgttcttaccgattgcttcaacgctggtttcacacccgccgccgggctggtggtggctggtgttggtcggctgggcgttcgtctggccgcatttagcctggcagatagcgagcagggccgtcgatccgcttagccgggaaatttacaacttaaaaaccgatgcagtattagcgggaatgtgggtaggcgtaatgggcgtaaacgtgctgccttccaccgcgatgttgatgattatgtgtctgaatttgatgggggcaggcggcccccgtctgtttgtcgcgggtctggtgttgatggtggtttcctgccttgtcaccctcgagctgacgggcattaccgtgtcgttcaatagtgcgccgctggaatggtggctctcccttcccattattgtcatttatcctctgctgtttggctgggtcagctaccagacggcaaccaaactggcggaacataaacgcaggttgcaggtcatgagtacccgcgacggcatgacgggcgtgtataaccgacgtcattgggaaactatgttacgcaatgaatttgataactgtcggcggcataatcgcgatgcaacgttactgattatcgatatcgaccatttcaagagcatcaacgatacctggggccatgatgtgggcgatgaagcgattgtggcgcttacccgacagttacaaattaccctgcgcggtagcgatgtgattggtcggtttggcggcgatgagtttgcagtaatcatgtccggtacgccagctgagagcgccattaccgccatgttacgggtgcatgaagggctaaatacattacgtttgccgaatacgccacaggtaactttacggattagtgtgggggttgcgccgctgaacccacaaatgagtcactatcgtgagtggttgaaatcggcagatttggcgctttacaaagcaaagaaagccggacgtaaccgcaccgaagtggcggcctgacgtccggcgaaagtcatcaggatttgctgagtttttctgatttttccatacacttcgtcatcgcttcgatcactgcagcacggaagcctttctcttccagtacgcgtaccgcttcaatggtggtgcctcccggtgagcagaccatatctttcagtgcccccggatgttctcccgtttccagcaccatttttgcggaacccattaccgcctgagcggcaaatttatacgcctgggcgcgtggcatcccgcccagcacggcggcgtcggccatcgcttcgataaacataaatacgtaggctggcgaagaaccgctcacaccgaccaccgggtggatcatcggctcagcaattacttccgcttcgccaaagcagcggaaaatattcagcacatcagcggtatcttctggggttaccagcgcgtttggcgttacggaggtcatcccggcattaaccagtgcgggagtgttcggcatggcgcggataattttccggtcatggcccagcgcgcgggcaagctggtcgagcgtgacacctgcagcaatagaaacgaccagagagtctttattcaggctggaggtgatttcgctaagcactttaatcatgatgccaggtttaacggcagcaaaaatgatgtcggcgatttgcgccacttcttgcgccgattctgcggcgttgatgccgaactggtcatgcagggcggcgactttatccggggagggggtgtatacccagatttgccctggaagcacctgaccgctggcaatcagaccgccgagaatggcttttcccatattgccgcagccaataaaaccgattttcttttccattgcctcactcctgccgtgaaattcattgttttgataatcgctggcagaagcataaacagaactatgccggaaggcaaaagcgcgacacaatagaggattacccaacaaaggatgactttatgacaatttgggtggatgccgacgcgtgtcccaatgtaattaaagagattttgtatcgcgcggcggaacgtatgcagatgccgctggtactggtagcaaaccagagtttacgcgtgccgccatcgcgatttattcgtacgctgcgcgtcgcggcaggtttcgacgttgccgataacgaaattgtccggcagtgtgaagcgggcgatttggtgatcaccgcagatatacctttggctgctgaagccatcgagaaaggcgctgcggcgcttaatccgcgcggcgaacgttacacgccagcgaccattcgtgagcgcctgacgatgcgcgattttatggataccttacgtgccagtgggatccagaccggcggaccagatagcctttcacaacgtgaccgccaggcctttgccgcggagctggagaagtggtggctggaagtgcaacgtagtcgtggctaaatgtaatttattatttacacttcattcttgaatatttattggtatagtaaggggtgtattgagattttcactttaagtggaattttttctttacaatcgaaattgtactagtttgatggtatgatcgctattctcatgacaccggctttcgccgcattgcgacctattggggaaaacccacgatgacacaacctctttttctgatcgggcctcggggctgtggtaaaacaacggtcggaatggcccttgccgattcgcttaaccgtcggtttgtcgataccgatcagtggttgcaatcacagctcaatatgacggtcgcggagatcgtcgaaagggaagagtgggcgggatttcgcgccagagaaacggcggcgctggaagcggtaactgcgccatccaccgttatcgctacaggcggcggcattattctgacggaatttaatcgtcacttcatgcaaaataacgggatcgtggtttatttgtgtgcgccagtatcagtcctggttaaccgactgcaagctgcaccggaagaagatttacggccaaccttaacgggaaaaccgctgagcgaagaagttcaggaagtgctggaagaacgcgatgcgctatatcgcgaagttgcgcatattatcatcgacgcaacaaacgaacccagccaggtgatttctgaaattcgcagcgccctggcacagacgatcaattgttgattttcgagcgcctatacttaacgttcatcccgtgaaataaggaagaacgatgccaacgaaaccgccttatcctcgtgaagcatatatagtgacgattgaaaaaggaaagccaggacagacggtaacctggtaccaactcagagccgatcatcctaaaccagactcgttgatcagtgaacatccgaccgctcaggaagcgatggatgcgaaaaaacgctatgaggaccctgacaaagagtgaccgcatcagactgctcggaagggattctgagtgccactacaagggatctgcgtcacatttttcataattcatgtttttctaataattagaatattaaacaataacaatccattactggaatcatttggaatctttacattatgccgtgcacgtctgctgctacgctttttgtcatttgtagcacaagtaagtgtcagcagtggtgcttcacacttgcccggtaattaacgacgaaagaaaagtaaggtggatgaacaatgagtgcgtcgttggcgatcctgaccatcggcattgtacctatgcaggaagttttgccgctcctgacggaatacattgacgaagataatatttcccatcatagcctgctggggaagttaagtcgtgaagaagtgatggcggagtacgcgccagaagcaggcgaagacaccattctcacattattaaatgacaaccagctggcccatgtttcgcgtcgcaaagtggagcgtgacctgcaaggtgtggttgaagtgctcgataatcagggttatgacgtcattttattaatgagtacagcaaacattagtagtatgactgcgcgtaatacgatctttcttgagccgtcgcgaatattgcctccactggtttcctctattgttgaagatcatcaggtgggggttatcgttccggttgaggagatgctgcccgttcaggcgcaaaaatggcaaattttgcagaaatcgccggtattttcattgggtaaccccattcatgattcagaacaaaaaatcattgatgccgggaaagaattactggcaaaaggggctgatgtcatcatgctggattgtttaggatttcaccaacgtcatcgcgatttactgcaaaaacagctcgatgttcctgtcttgctgtctaacgtattgattgcacggctggctgcggaattactggtgtaattttgcgtgacagccagcgcctctggcccctatagtgaagtagatgttcaactaccaaacagggccagtttatgcttcaaagtaatgagtacttttccggcaaagtgaaatcaatcggcttttccagcagcagcactggtcgcgccagcgtgggtgttatggttgaaggcgaatacaccttcagcaccgctgagccggaagagatgacggtaatcagtggcgcgctgaatgtgttactgcctgacgcgaccgactggcaggtgtatgaagccggttcggtgtttaatgttcccggtcacagtgagtttcatctgcaagttgccgaacccacctcttatctgtgccgctatctgtaattcctcgccttccccttgaacgggagggcatttttctgaaatatcctttctttagcccataataatatttcctttgctgcgattttttcaatttccgatatattcataatttatcaaggttgatataaatatcagtgaagatctccagatattgttgcggaactggctacgataaaagataaatcagatgatgaatggtggcgtgcattgctgcaaagtcgcaatgatcatttacgccaaacggcattgcgcaacgcacataccccggcgttgttgttaacgacattgactgagcctcaggatcggtcgctggctattaataatccacagctggctgccgatgtgaaaacggcgtggttaaaagaggatccatcattactcttatttgtcgaacaacccgatctttcgctgttacgtgatttagtgaaaaccggggcaacgcggaaaattcgcagtgaagcgcgtcaccggcttgaggaaaaacaatgacacaacgtccatggagcaagttacagcgtaaaacgcataatattgctgcgctaaaaattattgctcgccgtagcgaataattatatgcctggtgtggcttcgtacgccggataagacgcggcaggcgtcgcatccggcattaaaggaaaatcagcaattaacgttgtgcttcgccacctaatccttcaatcaggttttgaattaacgctgccagttcaccagtcatcaggatgaaatcggcatcaaaacgctgggcgaaatcttcacggtcgatatcttcgttttgatcgcgcagctcgtcgcagaacttcagacgcttgagcgaaccatcgtcgcacatcacaaactgaatgcgctgctgccagtcgagcgccagtttagtcaccacttttccggcttcaatgtgattggtgatctcttcgctggtcagatcttgtttcttcgcgcggatcacgccgccatcttccagcaacgatttcagctcggcttcatcaagcagctggaagccctgtgccgcactaccggagcgaacccattcggtcagcgtcagttcaatcgggttttccatgctcaatggtacaaccggtaacgaccccaggcttttacgcagtaatgccagcgtatcttccgcttttttggcactggcgcagtccaccataatcaaaccgttaaccgtgtcgatccacatcattgtctggctaaaacggctgaaagcacgcggcagcagagagtgcagcacttcgtctttcagcgaatctttttcggttttcttcagcttacgcgcctgttccgcttccagtttggcgattttcgcttccagcgcctgtttaatcaccggagacgggaggattttttcttctttgcgcgcgcagataacaatttgaccattggcaacgtgcgttaacgcatcgctgtgcgatcccatcggaggaacccagcccatcttcgccatgtcctggctgccgcatggggtaaatgccatcgaggctagctgtttttccatctcttctgcacgcagcgaaatctcgcggctaagacggtaaaccattaaatttttgaaccacagcatgataatttccacggccttgtcgttaaatttagcgggcatgataacgaattgtcggcggccttgcattgccaatccggttgtccgtctctacgctattgatattgaaaaaaataaggagagtaccgtgcgtataggtatcgatttaggcggcaccaaaactgaagtgattgcactgggcgatgcaggggagcagttgtaccgccatcgtctgcccacgccgcgtgatgattaccggcagactattgaaacgatcgccacgttggttgatatggcggagcaggcgacggggcagcgcggaacggtaggtatgggcattcctggctcaatttcgccttacaccggtgtggtgaagaatgccaattcaacctggctcaacggtcagccattcgataaagacttaagcgcgaggttgcagcgggaagtgcggctggcaaatgacgctaactgtctggcggtttcagaagcagtagatggcgcggcagcgggagcgcagacggtatttgccgtgattatcggcacgggatgcggcgcgggcgtggcattcaatgggcgggcgcatatcggcggcaatggcacggcaggtgagtggggacacaatccgctaccgtggatggacgaagacgaactgcgttatcgcgaggaagtcccttgttattgcggtaaacaaggttgtattgaaacctttatttcgggcacgggattcgcgatggattatcgtcgtttgagcggacatgcgctgaaaggcagtgaaattatccgcctggttgaagaaagcgatccggtagcggaactggcattgcgtcgctacgagctgcggctggcaaaatcgctggcacatgtcgtgaatattctcgatccggatgtgattgtcctggggggcgggatgagcaatgtagaccgtttatatcaaacggttgggcagttgattaaacaatttgtcttcggcggcgaatgtgaaacgccggtgcgtaaggcgaagcacggtgattccagcggcgtacgcggcgctgcgtggttatggccacaagagtaaaaaacgtaggcaattggcgcatcatgcctgatgcgacgcttgccgcgtcttatcaggcctacaaaaggtgccagaaccgtaggccggataaggcgttcacgccgcatccggcaataagtgctccgatgcctgatgcgacgcttgccgcgtcttatcaggcctgcaaaatgtgccagaaccgcgtagggcggataaggcgttcacgccgcatccggcaataagtaatgagcaccgagactataacctaccccagtggtttcgccagcaccggagtatccgccgcttgctggcgcttatagcgaccatacagcagcaacgacgacatcgcagcaaacgaaagcagggcggcaggcagcgccacgtaattatatgccagccccagcgtcagcatcatacctccgcaatatgcgccgacggcgctaccgaggttaaacgctatttgcccacctgcggcacctaataactctccgcctttggcgttttgtagtaacaatatttgtagcggtgctgaaagggcaaataatcccgcgcaacaaataaaagcaaaaataagcgacgttgttttcatgccgccgcagaaaaagagcatcagcagtgccagtacaattataaagtcagtcactgctgcaatgcgcagtggtgaataacgtcctgaaatcctgccacttagcatatttcccagcaccatccctagcccaactaacatcataataaaggtcatcgccgtttccgaaaaaccggaaataaacatcatgtatggctttacgtagctgaaccaggcaaacacacctgcgttgccaaacatcgtggcggcgaaaattaaccacggggccgggctgcgcaaaaagtgaaattgttcgcgcagatttcctttcgcctcgtcgcgaatatctggcacccaaaaatagaccgatgccatcaccgcaatattaaaaacagcgatcaataaaaaggtgtaacgccagctaaattcctgacttaaatacgttcccagcggaatgcccagcaaattggcgactgtcatcccggaaaccatccccgccacggcggcggtgacttttccgggtttgataatttttgataacacgatcgctccgacgccaaaaaatgcgccatgcggaaagccggataccagccgaccaatggcgagcatcaggtaagacgaagagagcgtgaacatggcgttgccaatgacgcacaacgccaccagaaacaacaagatatgtttgagtgagtagcggctggaaaagagtgcgatgattggcgcaccgaccaccacccccagtgcataatacgagatcatatgcccggcggcaggaatcgaaattcctacgttatgcgccagctccgtgagcacgcccataatgccaaattcggccatccccaaaccaaacgtgcccagagccaaagataaaatgacttttttcataccaccatcacaaccaccagaacggctaccaatcaccgtagccaataaagtgatagcttgcaggataacgaccagcaaggccaagagataattcgcccctctgtattcattatcctgctgaatagttatttcactgcaaacgtactttccagtttgctgtagcccaggccgttgatctttttcactttgatctgcaccggaatacgctctttcatcgcttctacgtggctaatcacaccgatggttttgccactggcgttcagggcatccagcgcatcaagggcggtatccagcgtttcgctatccagcgtgccaaaaccttcatcaaggaacagcgagtcaatacgtgttttatggctgaccagatccgaaagcgccagcgccagcgccagactaacgaggaaactttcgccgccggaaagggtacgggtatcgcgtaccgcatctgcctgccaggtatcaacaacctcgacttccagcgcctcgctggctttgcgctgtaacagatagcgcccgtgcagccgggtaagttgctgattagcgagatggactaaattatccagcgtcagcccctgggcaaacttgcggaatttatcgccctctttggaacctattagcgaattcagatatccccagtcctcaacctgctgcgtcatttgagcaatttgctgcattaaggtttgttgttgctgacggttatctgcatcctgcttcagctgctggcgaatctcgccttgactcgtggtgttttcacgcaacttttggtgagtttgcgctaactcttgctgaatctgctccaccgtcacagtgagagccaacccgtcgtcaggtcggtgttgttgatgctgtgccagcgtttctgctgtctgagtgaccagagtttgcgcctgacggcgctggttttccagattctgcttgagctgttccagctgcgttagtgtttgttcatccattagcgccgcaaggaacgcctgctgatcgtcaaagacgctggcctgtagcgcggtgtcaaactgcgcctgggctttttgcagactttgcgccgccagaacatcctgttgctgtaacgtctgctgctggctgtgtaatgcgagacattgttcatgtacctgccgccagttttccaataccacagtttcttcgcagtgcgggagttcatcactttgcggcaacgtttccagaatcggcgtcagctgctgaatacggttttgcagcgcggttaattcgttctggcgttgctgccagctctgcgcttcttgctgacgtgtcgccaaccagctctcttcttcatcttcctgtggcaatgtcagtgcataacccgtcaatgtcgttaaaagtagttgctggcgttgttcaatttgctgttgatactggataatttgctgattatgcgcggcaatctgcccttgtaattcatgccgttggctgagtaaccgcagctggcgttcgtgctcatcttgtgcatccagccacggttgaatatcgtccagtggctgcaaggtgatattgaggctggccgtgacggcttgccattgttgagtaagtgcttgctcatcttgtcggaggctttgcgcttcgttttcatcacgctgaagctgctttgttatggcgtccagttgcccacgtagcgtcgcaccttcttcaccgagctttttaacttcgttttccagcgccagtaatcgagactgattaacgccaggctccagcgcctgatacgcctcgaccgccgggtggctggtggaaccacaaagtgggcaaggctgacccgcctgtaactgtgcacgttgagcttccagcgttttgatgcgcgcttcctgctcgcaaatggttttcacatcggcaagttgctgcgtcttttctttataacgctggcgcatttcgttaagtgcggcgttacgttgcgtctgttcttgcgtgacattctggatagcgacctgtaactgcgccagacgtttttgttggggaacaatctgtccatgcagcgcgaccaggtgctgacgcagtgggcgttgctcagcatgttgcgccagggcggtagcaacttcatcggcggttaacgtcaacgtgatcgccgcaagcgcattaagtttttgctcagcatgggttaactgttgctgccattgccgcagatgctcgcgatcgctggtttgttgggagaactgcgcacgccaacccgccggttcgttgttccactgacggaagcggtcgtgttcctgtaaccaggtattcaggctttgttgctgctgctgtaattctgctgactgcttcgccgcgtggtggcgaatgctcgcgcgaagcgccattgtgctctgtaagcgagtatttacttcttcaatctgctggcgaatatgcgccagcgccgcgctgtgttctgcgatgcgttcccagtgtggacgaagatttcgtgccggttgtgccagactaagcgccgccagttgaggttgcgctttttcttcttcggctaacgcctgttgcaaggcctgctgacggcggctggcttcttgctgcaattcgtcctgacgcgttaaccagtttagcgattgttgttcttgctgctgcgcggtaattaactgtttttcttcgtcagtaagtacctgcaaactcgctgtcagcgattgcacttgttccggcgtgagcaacgtgacgccgctggcctgcgcttgcagcttctccagctctgtgcgggccgatttgtgctgctcaaaaaccatcgccgagatttgcccgtagatttcagtgccggttaactcctcgagcaattccgcgcgttctttgggtttggcattcaggaaggcagcaaattgcccctgcgaaagcagcatcgaacgggtgaagcgcccgtaatccagcccggttaacgtcgctgtcagttccagcttatctttcactttgtcggcgagaattttgccgtcggcgcagcgcgccagctctacgcgtggcacctgcaaattaccgtcgggttggttacgcgcccgattctggctccagaatgcacggtacgcttcacctttcacttcaaactccacctccgccagacattcggcggtatcgcgggtcatgagatcattttgcgattgtgaaacgttagagagacgcggagtttcgtgatacagcgccagacaaatggcgtccagcagggtggttttccccgcacctgttgggccggtaatagcaaacagcccgttgctggcgaacggctcgcgggtgaaatcaatcttccattcgccttttaatgagttcaggtttttcaggcgcaggctgagaattttcatgcttcgtgttctccggcgagggtatgcaacgtcgtggtgaaaagatgctgcagacgttgctgctgcgattcatccagttcttccagtgccagacggcgattgaacacctcttcgacgctgagttcgctgagggtttcacgctgttggctggctaacacacgctcgcgctgttcacgactccgacgtaccagcaatacttcgacaggcaatgattcggttaatgcctggattttgcgctgaatatcatgcagatactcatcagtagtgatttcgatatccagccagacaggtggctcctgcgatacatcgcgccactgttccagctgtgcggtaatcgacgccagatcgcctttcagcactgccatgggttgcgttaccggtacgttcaggttttccacgctctctaatttgccgtttgaaaatgtcaccagatggacatatttactcttaccgcattcatcaaaactcagtggaatgggggagccgcaatagcgaacatgttccatgccgccaataatctgtgcgcggtgaatatgcccgagcgcgatgtagtcggctggtggaaagttttgtgccggaaacgcgtccagcgtgccaatataaatgtcacgcacggcgtcacttttactggcccccacggtcgttaaatgtcccgtggcgatgatgggcagaggctgatcgccgcgcagtttgcaggcatcggcatagtgttgttggtaataatcggtaatcgctgccagtaaatgctgctgtttttcaataccgttaagccccgcctggctggtaataatgtcacgcggacgtaaaaacggaatggggcacagcactgcgcctggcgtcccgtcgcgacgaggcaagatttgcggcgcatgtccggcgctggcgaccacggtagtattgaggaacgccatgatatcgcgcgattcattcagcgtggcgaccgagtcatggtttcctgccagtaccaccagatgacagccagtttgctgtaaattgacaacaaaacggttgtataacgtgcgggcgtaactgggcggcgagccggtatcgaaaacatcaccggcaacaataatcgcatccacctgatgggtttgtgctgtctccagcagccagtcaagaaaagcctgatgttcagcttcgcggcttttactgtagaagttctggccgagatgccagtctgaggtgtgaaggatgcgcataacggttccctggcgaaaaagcatgggcgcgattatacccaaacagatgtgccatttgcttttttctgcgccacggaaatcaataacctgaagatatgtgcgacgagcttttcataaatctgtcataaatctgacgcataatgacgtcgcattaatgatcgcaacctatttattacaacagggcaaatcatggcgagacgtattctggtcgtagaagatgaagctccaattcgcgaaatggtctgcttcgtgctcgaacaaaatggctttcagccggtcgaagcggaagattatgacagtgctgtgaatcaactgaatgaaccctggccggatttaattctcctcgactggatgttacctggcggctccggtatccagttcatcaaacacctcaagcgcgagtcgatgacccgggatattccagtggtgatgttgaccgccagaggggaagaagaagatcgcgtgcgcggccttgaaaccggcgcggatgactatatcaccaagccgttttcgccgaaggagctggtggcgcgaatcaaagcggtaatgcgccgtatttcgccaatggcggtggaagaggtgattgagatgcagggattaagtctcgacccgacatctcaccgagtgatggcgggcgaagagccgctggagatggggccgacagaatttaaactgctgcacttttttatgacgcatcctgagcgcgtgtacagccgcgagcagctgttaaaccacgtctggggaactaacgtgtatgtggaagaccgcacggtcgatgtccacattcgtcgcctgcgtaaagcactggagcccggcgggcatgaccgcatggtgcagaccgtgcgcggtacaggatatcgtttttcaacccgcttttaacgccttgctcatcggacgcagagcagggcttatgatttcttaactggagtatcttacgtgctggaacggctgtcgtggaaaaggctggtgctggagctgctactttgctgcctcccggctttcatcctgggtgcattttttggttacctgccctggtttttgctggcatcggtaacaggactgcttatctggcatttctggaatttattgcgcctttcatggtggctgtgggtggatcgcagtatgaccccgccaccggggcgtggtagctgggaaccgctactatacggcttacaccagatgcagctgcgaaataaaaaacgccgccgtgaactgggcaatctgattaaacgctttcgtagcggcgcggagtcgctgcccgacgcggtggtgctgaccacggaagagggcggtattttctggtgtaacggtctggcgcaacaaattcttggtttgcgctggccggaagataacgggcagaacatccttaacctactgcgttacccggagtttacgcaatatctgaaaacgcgtgatttttctcgcccgctcaatctggtgctcaacaccgggcggcatctggaaattcgcgtcatgccttatacccacaaacagttgctgatggtggcgcgtgatgtcacgcaaatgcatcaactggaaggggcgcggcgtaacttttttgccaacgtgagccatgagttacgtacgccattgaccgtgttacagggttacctggagatgatgaatgagcagccgctggaaggcgcggtacgcgaaaaagcgttgcacaccatgcgcgagcagacccagcggatggaaggactggtgaagcaattgctgacgctgtcgaaaatagaagccgcaccgacgcatttgctcaatgaaaaggttgatgtgccgatgatgctgcgcgttgttgagcgcgaggctcagactctgagtcagaaaaaacagacatttacctttgagatagataacggcctcaaggtgtctggcaacgaagatcagctacgcagtgcgatttcgaacctggtctataacgccgtgaatcatacgccggaaggcacgcatatcaccgtacgctggcagcgagtgccgcacggtgccgaatttagcgttgaagataacggaccgggcattgcaccggagcatattccgcgcctgaccgagcgtttttatcgcgttgataaagcgcgttcccggcaaaccggcggtagcggattagggttagcgatcgtgaaacatgctgtgaatcatcacgaaagtcgcctgaatattgagagtacagtaggaaaaggaacacgtttcagttttgttatcccggaacgtttaattgccaaaaacagcgattaatccgcctttgtcatcttttattgccataagccagtcgatgctggcttattttctttgcagtcaaaatacgggcgttagattttacaacgattggtgattttttgttcgcatgattagccatgtctttttcacggaaatagtgttttatactggttggtgatttcttatcgctatatacctctggtttttagatccctccttgctttaaaacgttataagcgtttaaattgcgcttcaggtgctgtcatactgactgcattaacgcggtaaatcgaaaaactattcttcgccgcgcctggttgggagtatttcccgctaaaattgtttaaatataccgctgtatcatccccagggattggcacaaaaatttaacgttacaacaccacatccacaggcagtatgatttatgacccatcaattaagatcgcgcgatatcatcgctctgggctttatgacatttgcgttgttcgtcggcgcaggtaacattattttccctccaatggtcggcttacaggcaggcgaacacgtctggactgcggcattcggcttcctcattactgccgttggcctgccggtattaacggtagtggcgctggcaaaagttggcggcggtgttgacagcctcagcacgccaatcggtaaagtcgctggcgtactgctggcaacggtttgttacctggcggtggggccgcttttcgctacgccgcgtacagctaccgtttcctttgaagtggggattgcgccgctgacgggtgattccgcgctgccgctgtttatctacagcctggtctatttcgctatcgttattctggtttcgctctatccgggcaagctgctggataccgtgggcaacttccttgcgccgctgaaaattatcgcgctggtcatcctgtctgttgccgctattgtctggccggcgggttctatcagcacggcgactgaggcttatcaaaacgctgcgttttctaacggcttcgttaacggctatctgaccatggatacgctgggcgcaatggtgtttggtatcgttattgttaacgcggcgcgttctcgtggcgttaccgaagcgcgtctgctgacccgttataccgtctgggctggcctgatggcgggtgttggtctgactctgctgtacctggcgctgttccgtctggggtcagacagcgcgtcgctggtcgatcagtctgcaaacggcgctgctattctgcatgcttacgttcagcacacctttggcggcggcggtagcttcctgctggcggcgttaatcttcatcgcctgcctggtaacggcagttggcctgacctgtgcttgtgcagaattctttgcccagtacgtaccgctctcttatcgtacgctggtgtttatcctcggcggcttctcgatggtggtttctaacctcggcttaagccagctgatccagatctccgtaccggtgctgaccgctatttatccgccgtgtatcgcactggttgtattaagttttacacgctcatggtggcataattcgtcccgcgtgattgctccgccgatgtttatcagcctgctttttggtattctcgacgggatcaaagcatctgcattcagcgatatcttaccgtcctgggcgcagcgtttaccgctggccgaacaaggtctggcgtggttaatgccaacagtggtgatggtggttctggccattatctgggatcgcgcggcaggtcgtcaggtgacctccagcgctcactaaatcactgaacatttgttttaaccacggggctgcgatgccccgtggttttttattgtgttgatgggttaggaattgatggaaagtaagaacaagctaaagcgtgggctaagtacccgccacatacgctttatggcactgggttcagcaattggcaccgggctgttttacggttcggcagacgccatcaaaatggccggtccgagcgtgttgttggcctatattatcggtggtatcgcggcgtatatcattatgcgtgcgctgggggaaatgtcggtacataacccggccgccagctctttctcgcgttatgcgcaggaaaacctcggcccgctggcaggttacattaccggctggacctactgctttgaaatccttattgtcgccatcgccgatgtgaccgcttttggtatctatatgggtgtctggttcccgacggtgccgcactggatttgggtactgagcgtggtgctgatcatttgcgccgtaaacctgatgagcgtgaaggtattcggtgagctggaattctggttctcgttctttaaagtcgccaccatcatcatcatgattgtcgccggtttcggcatcatcatctgggggattggcaacggcgggcaaccgaccggtattcataacctgtggagcaacggcggcttcttcagtaacggctggcttggcatggtaatgtcgttgcaaatggtgatgtttgcttacggtgggatcgaaattatcgggattaccgccggtgaagcgaaagatcctgagaaatcgataccgcgtgcgattaactccgtgccgatgcgtattctggtgttctacgtcggtacgctgttcgtcattatgtctatctacccgtggaatcaggttggcactgccggtagcccgttcgtgctgacgttccagcatatgggcattacctttgccgccagcattcttaactttgttgtgctgactgcttcgctgtcggcaattaacagtgatgtatttggcgtaggccgtatgctccacggtatggcagagcagggcagcgcgccgaaaattttcagcaaaacgtcgcgtcgcggtattccgtgggttacggtgctggtgatgactaccgcgctgctgtttgcggtgtatctgaactacatcatgccggaaaacgtcttcctggtgatcgcttcgctggcaaccttcgccacggtgtgggtgtggattatgatcctgctgtcgcaaattgccttccgtcgccgtttgccgccagaagaagttaaggcgctgaaatttaaagtgccgggtggggtagcaacgaccatcggcgggctgattttcctgctctttattatcgggttgattggttatcacccggatacgcgtatctcgctgtatgtcggtttcgcgtggattgttgtgctgttgattggctggatgtttaaacgccgccacgatcgtcagctggctgaaaaccagtaatccttgcgttctgtaagccggttcaggaggaaatcctgatccggctattccgaaagttatccgcccccgtcctcctcccccaaatatccttcagatgatgagtgatcctgcattaggctatggcaaggtgatcagattttcatcacaggggaattatgatgttaaatgcatggcacctgccggtgcccccatttgttaaacaaagcaaagatcaactgctcattacactgtggctgacgggcgaagacccaccgcagcgcattatgctgcgtacagaacacgataacgaagaaatgtcagtaccgatgcataagcagcgcagtcagccgcagcctggcgtcaccgcatggcgtgcggcgattgatctctccagcggacaaccccggcggcgttacagtttcaaactgctgtggcacgatcgccagcgttggtttacaccgcagggcttcagccgaatgccgccggcacgactggagcagtttgccgtcgatgtaccggatatcggcccacaatgggctgcggatcagattttttatcagatcttccctgatcgttttgcgcgtagtcttcctcgtgaagctgaacaggatcatgtctattaccatcatgcagccggacaagagatcatcttgcgtgactgggatgaaccggtcacggcgcaggcgggcggatcaacgttctatggcggcgatctggacgggataagcgaaaaactgccgtatctgaaaaagcttggcgtgacagcgctgtatctcaatccggtgtttaaagctcccagcgtacataaatacgataccgaggattatcgccatgtcgatccgcagtttggcggtgatggggcgttgctgcgtttgcgacacaatacgcagcagctgggaatgcggctggtgctggacggcgtgtttaaccacagtggcgattcccatgcctggtttgacaggcataatcgtggcacgggtggtgcttgtcacaaccccgaatcgccctggcgcgactggtactcgtttagtgatgatggcacggcgctcgactggcttggctatgccagcttgccgaagctggattatcagtcggaaagtctggtgaatgaaatttatcgcggggaagacagtattgtccgccactggctgaaagcgccgtggaatatggacggctggcggctggatgtggtgcatatgctgggggaggcgggtggggcgcgcaataatatgcagcacgttgccgggatcaccgaagcggcgaaagaaacccagccggaagcgtatattgtcggcgaacattttggcgatgcacggcaatggttacaggccgatgtggaagatgccgccatgaactatcgtggcttcacattcccgttgtggggatttcttgccaataccgatatctcttacgatccgcagcaaattgatgcccaaacctgtatggcctggatggataattaccgcgcagggctttctcatcaacaacaattacgtatgtttaatcagctcgacagccacgatactgcgcgatttaaaacgctgctcggtcgggatattgcgcgcctgccgctggcggtggtctggctgttcacctggcctggtgtaccgtgcatttattacggtgatgaagtaggactggatggcaaaaacgatccgttttgccgtaaaccgttcccctggcaggtggaaaagcaggatacggcgttattcgcgctgtaccagcgaatgattgcgctgcgtaagaaaagtcaggcgctacgtcatggcggctgtcaggtgctgtatgcggaagataacgtggtggtatttgtccgcgtgctgaatcagcaacgtgtactggtggcaatcaaccgtggcgaggcctgtgaagtggtgctacccgcgtcaccgtttctcaatgccgtgcaatggcaatgcaaagaagggcatgggcaactgactgacgggattctggctttgcctgccatttcggctacggtatggatgaactaacgttttataacgccttgcgtgacgcctgcgccatcatccgcggataaaactgccagaagcgggtttcgagggcgtcataatgagcgtctaaatcgtaccaggagtcacgcagggcatccagacgtgggcggcggcttgccatgccgtttaacacgttctggatgaaatccatatcgcgatagcgcaccagccactgctctgaccacaagtaattgttcagattgataaaacgtggcggtgagtccggcaaaatcgtcatcacttgctcgcgggcataacagacaaattcctgtagcggaaagtccggcgacagctgcgaccagtggcgggaaagaaagtgatcccacatgacatccagcgtaataggcgcaacgcggcgcgtttcactacgaaaccactcccgtgcttcgcggacttccggcagattgtcagtcaatacgtcgatacgtcgatgcatatgaatgccagccacgacgtcgggcggaaaactttcttcaggatttccgcgtacgaaatcagccagtaaattgccggaaagcgagctttccgcgagatgggctaaatgcaggtgagctaaaaaattcatcgattatattctatccaaaagggggtaaaggttgcagggagagcgccccggcactagactacccgcctcttattttagtctgagtcagtgtcatgcgcgttaccgatttctcctttgaattgcccgaatccctgattgcccactatcccatgcctgaacgcagtagctgtcgtttactgtcgctggacgggccgacgggcgcgctgacgcacggtactttcaccgatttacttgataagctcaaccccggcgatcttctggtttttaataatacccgcgtgatcccggcgcgcctgtttgggcgtaaagccagcggcggcaagattgaagtgctggttgaacggatgctcgacgacaaacgcattcttgcgcatattcgcgcctcgaaagcgccaaaacctggcgcagaactgctgctgggcgatgacgaaagtattaacgcaacaatgaccgcgcgccacggcgcactgtttgaagtcgaatttaatgatgaacgctcggtgctggatattctcaacagcatcggccatatgccgctgccgccgtatatcgaccgtccggacgaagacgctgaccgcgaactttatcaaaccgtttatagcgaaaaaccgggcgcggttgcagccccgaccgcaggtctgcattttgacgagcctttgctggaaaaattgcgcgccaaaggcgtggagatggcgtttgtgacgttgcacgttggtgcgggcaccttccagccggtgcgcgtcgacaccattgaagatcacatcatgcactcggaatacgctgaagtaccgcaggatgtggtagacgcggtactggcggcgaaagcgcgcggtaaccgggtgattgcggttggcaccacttcagtacgttcgctggaaagcgcggctcaggcagcgaaaaacgatctcattgaaccgttcttcgacgatacccaaatctttatctatccgggcttccagtacaaagtggtcgatgcgctggtgacgaacttccacttgccagagtcgacgctgattatgctggtttcggcctttgccggttatcaacacaccatgaacgcctataaagcagcggtagaagagaaatatcgcttttttagttacggtgatgcgatgtttatcacgtacaatccgcaggcaattaatgagcgcgtcggggagtaattccgcggcgctggtttaaaacgttggactgtttttctgacgtagtggagaaaaaatgaaatttgaactggacaccaccgacggtcgcgcacgccgtggccgcctggtctttgatcgtggcgtagtggaaacgccttgttttatgcctgttggcacctacggcaccgtaaaagggatgacgccggaagaagttgaagccactggcgcgcaaattatcctcggcaacaccttccacctgtggctgcgcccgggccaggaaatcatgaaactgcacggcgatctgcacgattttatgcagtggaaggggccgatcctcaccgactccggcggcttccaggtcttcagccttggcgatattcgtaaaatcaccgaacagggcgtgcacttccgtaacccgatcaacggcgatccgattttcctcgatcctgaaaaatcaatggagattcagtacgatcttggttcggatatcgtcatgatctttgatgagtgtacgccgtatcctgctgactgggattacgcaaaacgctccatggagatgtctctgcgttgggcgaagcgtagccgtgagcgttttgacagtctcggaaacaaaaatgcgctgtttggtatcatccagggcagcgtttacgaagatttacgtgatatttctgttaaaggtctggtagatatcggttttgatggctacgctgtcggcggtctggctgtgggtgagccgaaagcagatatgcaccgcattctggagcatgtatgcccgcaaattccggcagacaaaccgcgttacctgatgggcgttggtaaaccagaagacctggttgaaggcgtacgtcgtggtatcgatatgtttgactgcgtaatgccaacccgcaacgcccgaaatggtcatttgttcgtgaccgatggcgtggtgaaaatccgcaatgcgaagtataagagcgatactggcccactcgatcctgagtgtgattgctacacctgtcgcaattattcacgcgcttacttgcatcatcttgaccgttgcaacgaaatattaggcgcgcgactcaacaccattcataaccttcgttactaccagcgtttgatggcgggtttacgcaaggctattgaagagggtaaattagagagcttcgtaactgatttttaccagcgtcaggggcgagaagtaccacctttgaacgttgattaatattaataatgagggaaatttaatgagcttttttatttctgatgcggtagcggcaacgggtgcaccggcgcaaggtagcccgatgtctttgattttgatgctggtggtattcggtctgattttctatttcatgatcctgcgtccacagcagaagcgcaccaaagaacacaaaaagctgatggactccattgccaaaggtgatgaagttctgacgaacggtggcctggttggtcgcgtaaccaaagtagcggaaaacggctacattgctatcgcgctgaatgacaccactgaagtagttattaaacgtgacttcgtagctgccgtcctgccgaaaggcaccatgaaggcgctgtaattaaaatttttccctaagggaattgccgtgttaaaccgttatcctttgtggaagtacgtcatgctgatcgtggtgattgtcatcggtctgctgtatgcgcttcccaacctgtttggtgaggatccggctgttcagatcactggtgcgcgcggagtcgccgccagtgagcaaacgctgatccaggtccagaaaacgttacaagaagaaaaaataactgctaagtctgtggcactggaagagggcgctattcttgcgcgcttcgactccactgacacccagttgcgcgctcgtgaagcattaatgggcgttatgggtgacaaatacgtcgtggcgcttaaccttgccccggcaacgccgcgctggctggcagctattcacgctgagccgatgaagctcggccttgacctgcgtggcggcgttcacttcctgatggaagtggatatggacaccgcgcttggcaaactccaggaacaaaatatcgatagcctacgcagtgacctgcgcgaaaagggcatcccgtataccactgttcgtaaagaaaacaactacggcctgagcatcactttccgcgatgctaaagctcgtgatgaagccattgcgtatctgagcaagcgccatccggacctggtgattagcagccagggcagcaaccagctgcgtgcggtaatgagcgatgctcgtctgagtgaagcgcgtgaatatgcggtgcagcagaacattaatatcctgcgtaaccgtgtaaaccaacttggcgtggcggagccggtggttcagcgtcagggtgctgaccgtatcgttgttgaactgccaggtattcaggacactgcgcgtgcgaaagagattctgggtgcgacggcaacgctggaattccgtctggtaaacaccaacgttgaccaggccgctgcggcatccggtcgcgtaccgggcgactctgaagtgaaacagacccgcgaaggtcagccagttgtgctgtacaaacgcgtaattctgaccggtgaccatatcaccgactccacttccagccaggacgaatacaaccaaccgcaggttaacatctcgctcgatagcgctggtggtaacatcatgtctaacttcactaaggacaacatcggcaaaccgatggcaaccctgtttgtggagtacaaagacagcggtaagaaagatgcaaatggtcgtgcggttctggtgaaacaggaagaggtgattaacatcgccaacatccagtctcgtctgggtaacagcttccgtatcaccggcatcaacaacccgaacgaagcccgtcagctgtcactgctgctgcgtgccggtgcgttgatcgcgccgattcagattgttgaagaacgtaccattggcccaaccctgggtatgcagaacattgaacaggggctggaggcttgccttgccggtctgctggtttctattctgttcatgatcatcttctataagaagtttggtctgattgcgaccagtgctctgattgccaacttgatcttaatcgtcggcattatgtcgctgttgccaggcgcaacgctgagtatgccaggtatcgcgggtatcgtcttaacccttgcggtggcggtcgatgcgaacgtactgatcaacgaacgtattaaagaagagttgagcaacggacgtactgttcaacaggcaattgatgaaggttatcgtggcgcattcagttctatcttcgatgcgaacatcaccacgctgattaaagtcatcatcctgtacgcagtgggtaccggggcaattaaagggttcgcgattactaccggtatcggtgtggcgacgtcgatgtttaccgcgattgtcggtacgcgtgccatcgtaaacctgctatatggcggcaagcgcgtcaagaagctgtcaatctgaggagtgcgatgtggcacaggaatatactgttgaacaactaaaccacggccgtaaagtctatgactttatgcgctgggactactgggctttcggcatctctggtctgctgttaatcgctgctatcgttattatgggcgtgcgcggctttaactgggggctggatttcaccggtggtacggttattgaaattacgctcgaaaaaccggctgaaattgacgtaatgcgtgatgcattgcaaaaagccggttttgaagagccgatgctgcaaaactttggtagcagccatgacatcatggtccgtatgccgcctgctgaaggcgaaaccggcggtcaggtgttgggcagccaggttctgaaggtgattaacgaatccaccaatcagaatgcagcagtgaagcgtattgagttcgtcggtccgagcgtgggggcagaccttgcgcaaaccggtgcgatggcgttgatggcagcgctgctgtctatcctcgtgtacgtaggtttccgctttgagtggcgactggcggcaggggtggttattgcgctggcgcacgacgttatcattacgctgggtattttgtcgttattccatatcgagattgacctgaccattgtggcatcgttgatgtcggttatcggttactcgcttaacgacagtatcgtggtatcggaccgtattcgtgaaaacttccgcaagatccgtcgcggtacgccttacgaaatctttaacgtgtccttgacccagacgctgcaccgtaccttgatcacatccggtactaccttgatggttatcctgatgctgtacctcttcggtggtccggtactggaaggcttctcgctgaccatgcttatcggtgtttccatcggtactgcatcttccatctatgtggcatctgcgttggctctgaaactgggtatgaagcgcgaacacatgttgcagcagaaagtggaaaaagaaggggcggatcagccgtcaattctgccgtaatcaagttcccgttgatgttgaaaatcccggtcagaagatcgggattttttttgatgtatggagattgcgaaaatccccgcatcttgggaaactgcgcgtaaccctacatttcatccaggtaacttttcatggctatcatcccaaaaaactatgcgcggttagaaagcggctatcgcgaaaaagcattaaaaatctatccgtgggtctgcggtcgctgttcccgcgagtttgtttattccaacctgcgtgaacttaccgttcaccacattgatcacgaccataccaataacccggaagatggcagtaactgggaattgttgtgtctctattgccacgatcatgagcattcgaaatataccgaagcggatcagtatggtacgaccgttatcgcaggggaagatgcgcagaaagatgtcggtgaagcgaagtacaacccattcgctgacctgaaagcgatgatgaacaagaagaagtgattaaaacgtaaaattgcctgatgcgctacgcttatcaggcctacgttatttcagcaatatattgaatttacgtgcttttgttggccggacaaagcgtttacgccgcatccggcatgaacaaagcacacgttgttaacaatcagaaatgccgggaataaatcccggcattttcataatcagaagttgtaacctactaccaggtaaccaccccagccggtagagcgaacgttgaagttgccgttgccgaagttcagttctgcatcgtcgttccactgaccaccgtcgtgccagtaacgagctacgacagagtagtgccagtgatcgtagttcagagccagaatatggctggaagcgatagagttattagtacgggtcttaataccgttgattgcgttaccgctgtcatcccctaaatcggaaccccagtcgaagttggtgaagccgatgtagctcagctgaccgccccacagatcggtaatcggcacaaagtatttaattttgaaacggtaaccgtcccactcgttttcgttcgctgcgccatagttctgccactggtatttcgcatagacgttcatggacaggctcatcggcaggccagtgtcgatatcggtacccagacccatgtaccaggtgctctggcgaccatctttattacgacccatgtcgtaaatgtagttgttcgcgaagtaccactctttgaacggaccgaagctaaggtcagtattggtcagcttgtcgatggagaaacgtggttcgatttccataaacagcggagaaccgtggttccagatacctttagcatcggagttaccgccgaagaataccggcgcatccgcataaccatagaagtcgaaccagtcttttttagcgaatgcttcgtactcaaggtaggtatcgttgcggatctgcggtccgaaacgggtgtgatagcttccgacaacgttaacgctctggtgccaccagtcggaaagatactgcggtttgtcgttttcagctgcgttgacagtaaaagacgaagagagcgccagtaccgcaccggctgccagtaatgtttttttcatatgtatgccactgtttgaaaatcccttgcgggagtgaaaaaggcgcaaattgcgtttctaaatatttcgtatacagaggagcctattataaaaatcattgctcacaaaaatatgtttcgtttcacagttctatcatttacgtaatcgattgcgttcacgtttacacacattcgggcggggattgtactgactttcgcccttgttgcaaacttttactatcaatccaggtgatgtaagcagagtaacaaaatgacggggaaagatgttgcgggacgcacaaaatcgtcccgaaatacgtttactgcataacaggttgaatgtcgtggatacgtacaaagcctaactgatccacagaaatcccctttaactgtaacggaatatcaacatcgctgggggcgaggacgctggcaggggcattaatcaattgattctgcacattgatttcctgaaagttgtctattgttccctgaatttgcccatattcaacagttccgctgaatgcgggcaagggatcattcgactcaccctgaatacgtagtgtaagggtggtgccatctgcatcaggcgtaatattcaccagcgacatacgtaaagtaccgatctggctttccagtcttgccggtgttttcgctccaggcagaaggtaaaccccactgctggattttgcattcagcctgttttgctgagtgattttgactgtttcttgattgagttgcgtcatctcctggttcagcgtgctgacgctgtgtttcatctgtcgcacttcactttgctgcacacaggcgctaaggctgaacaggcttcccagcaggagcagtcgaaaaacgttagtattcataggtcgtccctttctcgtcgcaattagcctaatggtagagggtaaaagcagcgaaagcatcgatcctttatctcaaaagcgttgcgcctttgttgtatcgtcagttcagggtaaaatagatttccgttaaccacctggtcaggacgccgtatgcattgcccattctgtttcgccgtggacactaaggtaattgactctcgtctcgtgggcgagggttcatccgtacgccgccgtcggcagtgtctggtgtgtaatgaacgtttcaccacctttgaagtggcggagctggttatgccgcgtgttgtaaaaagcaacgacgtgcgtgaaccgtttaatgaagagaaattgcgtagcggaatgctgcgggcgctggaaaaacgtccggtgagttccgatgacgtcgaaatggcaatcaatcatattaaatcgcagctgcgcgccaccggtgagcgcgaagtgccgagcaagatgattggcaatctggtgatggagcaattgaaaaagctcgataaagtcgcctatatccgttttgcctctgtctaccgcagtttcgaagatatcaaagaatttggcgaagagatcgcgcgcctggaggactaagccgtgcaggacgagtattacatggcgcgggcgctaaagctggcgcaacgaggacgttttaccacgcatcccaacccgaatgtcgggtgcgtcattgtcaaagatggcgaaattgtcggtgaaggttaccaccaacgtgcgggtgaaccacatgccgaagtacacgcgttgcgtatggcgggtgaaaaagccaaaggtgcgaccgcctatgtcacactcgaaccctgtagccatcatggtcgtacgccaccgtgctgtgacgcactcatcgccgctggcgtagcgcgcgtggttgcctcgatgcaagatcctaacccgcaggtcgctgggcgtggactttaccgtctgcaacaggctggcattgacgtcagccacggcctgatgatgagtgaagccgagcaattgaataaaggctttctcaagcggatgcgcaccggctttccttatattcagttaaaacttggcgcatcgcttgatggtcgcacggcgatggcgagcggcgaaagccagtggatcacttcgccccaggcgcggcgtgatgtacaactactgcgcgcgcaaagtcatgccattttaaccagcagcgccacggtgctggcggatgatcctgccttaacggtgcgttggtctgaactggatgaacaaactcaggcgctctatccgcaacaaaatctccgtcagccgatacgtattgtgattgatagccaaaatcgcgtgacgccggtacatcgcattgtgcagcagcccggcgaaacctggttcgcgcgtacgcaggaagattctcgtgagtggccggaaacggtgcgtaccttgctgattccagagcataaaggtcatctggatctggttgtactgatgatgcaactgggtaaacagcaaattaacagcatctgggtggaagcggggccaacgctcgctggcgcattgctgcaggcgggtttagtcgatgagctgattgtctatatcgcacctaaactattaggcagcgacgcccgcggattatgcacgctgccagggcttgagaaattagccgacgccccccaatttaaattcaaagagatacgtcatgtaggcccggatgtttgcctgcatttagtgggtgcatgatctcccggctcgaaagggaagcagcgcacgaaatattatgctaaaatccgcccccctgcggggccatactcgaacccgaaggaagaaaatgaacattattgaagctaacgttgctaccccggacgctcgcgtcgccatcaccatcgcgcgtttcaacaactttatcaatgacagcctgctggaaggtgcaattgacgcactgaaacgtatcggtcaggtaaaagatgaaaacattaccgttgtttgggtgcctggtgcctatgagctgccgctggcggcgggtgcactggctaaaaccggtaaatacgacgcggtgattgcgctgggtacggttattcgtggtggcactgcccactttgaatatgtcgctggtggtgcaagcaacggcctggcgcatgttgcccaggacagcgaaattccggttgcttttggggttctgaccactgaaagcattgaacaagcgatcgaacgtgctggcaccaaagctggcaacaaaggtgcagaagctgcactgaccgcgcttgaaatgattaatgtattgaaagccatcaaggcctgaaattagtaaggggaaatccgtgaaacctgctgctcgtcgccgcgctcgtgagtgtgccgtccaggcgctctactcctggcagttgtcccagaacgacatcgctgatgttgaataccagttcctggctgaacaggatgtaaaagacgttgacgtcctgtacttccgtgagctgctggccggggtggcgactaataccgcatacctcgacggactgatgaagccatacctgtcccgcctgctggaagaactgggacaggtagaaaaagcagtactgcgcattgcgctgtacgaactgtctaaacgtagcgatgtgccatacaaagtggccattaacgaagcgatcgaactggcgaaatcgttcggcgcagaagacagccataagttcgtcaacggcgtactcgataaagcagcacctgtgattcgccctaacaaaaagtgatatccaggccggtagattcacggaagaccgttccatgatcgccggccttttcttttttacctgctgaggcataacgtatggcatgtggcgagttctccctgattgcccgttattttgaccgtgtaagaagttctcgtcttgatgtcgaactgggcatcggcgacgattgcgcacttctcaatatccccgagaaacagaccctggcgatcagcactgatacgctggtggcgggtaaccatttcctccctgatatcgatcctgctgatctggcttataaagcactggcggtgaacctaagcgatctggcagcgatgggggccgatccggcctggctgacgctggcattaaccttaccggacgtagacgaagcgtggcttgagtccttcagcgacagtttgtttgatcttctcaattattacgatatgcaactcattggcggcgataccacgcgtgggccattatcaatgacgttgggtatccacggctttgttccgatgggacgagccttaacgcgctctggggcgaaaccgggtgactggatctatgtgaccggtacaccgggcgatagcgccgccgggctggcgattttgcaaaaccgtttgcaggttgccgatgctaaagatgcggactacttgatcaaacgtcatctccgtccatcgccgcgtattttacaggggcaggcactgcgcgatctggcaaattcagccatcgatctctctgacggtttgatttccgatctcgggcatatcgtgaaagccagcgactgcggcgcacgtattgacctggcattgctgccgttttctgatgcgctttctcgccatgttgaaccggaacaggcgctgcgctgggcgctctctggcggtgaagattacgagttgtgtttcactgtgccggaactgaaccgtggcgcgctggatgtggctctcggacacctgggcgtaccgtttacctgtatcgggcaaatgaccgccgatatcgaagggctttgttttattcgtgacggcgaacctgttacattagactggaaaggatatgaccattttgccacgccataaagatgtcgcgaaaagtcgcctgaagatgagtaatccgtggcatctacttgctgtcggattcggaagtggattaagcccgatcgttcctgggacgatgggctcgctggcagcgattccgttctggtatctgatgacctttttgccctggcagctctactcgctggtggtgatgctggggatctgtatcggcgtctatctttgtcatcaaacggcgaaagacatgggtgtgcacgatcatggcagcattgtctgggacgaatttattggtatgtggatcacgctcatggcgctgccgaccaatgactggcagtgggttgccgccgggtttgtgattttccgtattctggatatgtggaagccgtggccgatccgctggtttgatcgcaatgtgcatggcggcatggggatcatgatcgacgatattgtcgccggggtgatttccgcaggcatcctgtattttatcggtcatcactggccgctgggtattctgtcgtagttgtgcaccgatgcctgatgtgacgcttgtcacgtctcatcaggcctggactcttatttaaatcctacgacaggatgcggtttatacggcgtttccagttcggcaatctgttccggcttcaaagtgatatccaccgcgttcaatagctcatcaagctgttcttcgcgcgaagttccgataatcggtgcggcaatgcccggtttactcaacaaccaggccagcgcaacttgtgctcgtgtcgcccccagttcttcactgacgcctgttaaccgctctgcgatctgcgcgtcattttcatcgctttctttatagagatttttccccacctcatcagacaccagtcgtgcggtagtttctccccacggacgcgtcagacggccccttgccagcgggctccatggaattaccgccacgccctcctgataacacagtggtagcatctcgcgctcttcttcacgataaatcagattgtagtgatcctgcatactgacaaactgcgcccagccgtgctgtttttggagttccagtgcctgagcaaactgcgaagcgtgcattgatgacgcgccgatataacgcgctttcccggcttttaccacgtcgttgagggcttccagcgtctcttcgatcggcgtgttgtaatcccagcgatgaatttgcaggatatcgacataatccatgccgagacgtcgcaggctgtcgtcgatagagcgcaaaatttgcgcacgggataatccttccggtaaatcaccaacgcgatggaacactttggtcgcaacgaccacgtcttcacgacgggcgaaatcccgcagtgcgcgaccgacgatctcttcgctgctgccgtcagaataactgttggcggtatcaaagaaatttatgccgccttccagtgcacgtttaattatgggacggctgctttcttccggcagtgtccatgcgtgattaccgcgatctggctcgccaaaggtcatacagccgaggcaaagtcgggaaacgcgaaggtcggtttttcctaaggggttgtattgcatgctgccactcctgctatactcgtcatacttcaagttgcatgtgctgcggctgcattcgttcaccccagtcacttacttatgtaagctcctggggcttcactcgtttgccgccttcctgcaactcgaattatttagagtctatgaataatttcttaagcatagcaggagtggagtagggattatgccagccaggccttgattttggcttccataccagcggcatcgaggccgagttcggcgcgcatttcttcctgagttccttgcggaataaagaagtccggcaggccaatgttcagcacgggtactggtttacgatgggccatcagcacttcgttcacgccgctgcctgcgccgcccataatggcgttttcttctacggtgaccagcgcttcatggctggcggccatttccagaattaacgcttcatcaagcggtttcacaaaacgcatatcgaccagcgtggcgttcagcgattcggcgactttcgccgcttctggcatcagcgtaccaaagttaaggatcgccagtttctcgccacgacgcttcacaatgcctttgccaattggtagtttttccagcggcgtcagttccacgccgaccgcgttgccacgcgggtagcgcaccgctgacgggccatcgttatagtgatagccggtatagagcatctggcgacattcgttttcatcgctcggggtcataatgaccatttccggtatgcagcgcaggtaagagagatcaaaagcaccctgatgggtttgaccgtcagcaccaacaatgcccgcgcggtcgatggcgaacaggaccggaagcttttgaatcgccacgtcatgcagcacctgatcataggcgcgttgcaggaaagtggagtaaatcgcgacaatgggtttgtacccaccaatcgccagacccgcagcaaaggtcaccgcgtgttgctcggcaattgccacgtcgaagtagcgatccgggaatttacgtgaaaactcgaccatgccggaaccttcacgcatcgccggagtaatcgccatcagcttgttgtctttcgctgccgtttcgcacaaccagtcgccaaagatttttgaatagctcggcaaaccgccgctacttttcggcaaacaaccgctggagggatcaaatttaggcacggcgtggaaagtgatcgggtctttttctgccggttcataaccacgaccttttttggtcatgatatgcaggaactgcgggcctttcaggtcgcgcatgttctttagcgtggtgataagccccagcacatcgtgaccgtccaccgggccgatgtagttaaagcccagctcttcaaacaacgtgccaggcactaccatgcctttaatatgttcttcggtgcgtttgagcagctctttaattggcggcacgccagagaaaacttttttcccgccttcgcgcagtgaagagtaaagcttaccggaaagcagctgtgccagatggttgttgagcgcgccgacattttcggaaatcgacatttcattgtcgttgagaatcaccagcatatcaggacggatatcgcccgcgtgattcatcgcttcaaacgccatgcctgcggtaatcgcgccatcgccaatgacacagacggtgcggcgatttttgccttctttttcggcagcaaccgcaataccaattccggcactgatggaggttgatgaatgcccgacgcttaatacgtcatattcgctttcgccgcgccacgggaacgggtgcagaccgcctttctgacggatggtgccgattttgtcgcggcgtccggtcaaaattttatgcggataagcctgatgccccacatcccaaatcaattggtcaaacggggtgttgtagacatagtgcagcgccacggtcagttcgaccgtgcccagcccggaggcgaagtgcccgctggaacggctcacgctgtcgagtaaatagcggcgcagttcgtcgcagagtttcggtaaactctctttcggcaacagtcgtaactcctgggtggagtcgaccagtgccagggtcgggtatttggcaatatcaaaactcatcaggggcctattaatacttattgtttatttattacgctggatgatgtagtccgctagcgcttccagtgccgaggtatcgagtgactgttcagccagttgtttcagcgactgacgggcatcgtcgatcagatcccgggctttcttccgggcttgctcaagacccagaagtgcagggtaggtacttttaccaagttgctggtcggcaccctggcgttttcccaacgttgcagtatctcccaccacatccaggatgtcatcctgaacctggaaggcaaggccgatgctctctgcatacttgtcgagtaccggcagagcacgacgtcctttatctccggcgcttaatgcaccaaggcgaacggcggcgcgaatcaatgcgccggttttatgacgatgaatacgctcaagcgcgtccagaggtacgtgtttgccttccgcgtctaaatctaatgcctgaccaccgcacattccggcaataccactggcgctcgccagttcagaaatcatcgaaattctgtcgcggtccgacacttccggcatatcggcatcgcttaaaatcgagaacgccagcgtttgtaaagcgtcgccagcgagaatcgcgtttgcttcgccaaacttcacatggcaggttggcaaaccgcgacgcagatcgtcatcatccattgccggtaaatcatcatgaattaatgagtaagcgtggatacactcaacggcggcagcgggtgcgtccagcgtgtttgtgctaacgccgaacatatgaccggtggcataaaccaggaaaggtcgcaggcgcttaccacctaataatgcgccatactgcatggtttcgaccacgggagtgttctgaaagggcagtggggcgataaaacggctcagcgcctggttggcctgcttaacgcaggcttcgagttgctgcggaaagtccattactcattgtccggtgtaaaaggggttagagaggcgtcttcattgtcagacagcagaatttgtacgcgctgttcggcttgttgtaatttggcctgcccctgacgtgccagctgcacgccgcgttcgaactcgttcagcgcctcttccagcggcaggtcgccactttccagacgggttacaatctgttccagctcgctcagcgccttttcaaagctggcgggcgcctcatttttcttcggcataatgaatgtctgactctcaatatttttcgccccgtcatggtaacggactcagggcaaatagcaaataacgcgcaatggtaaggtgatgtgcacagcaaagcgatgttagtggtatacttccgcgcctggatgcagccgcaggtgtgggctgctgtatttttccctatacaagtcgcttaaggcttgccaacgaaccattgccgccatgaagtttatcattaaattgttcccggaaatcaccatcaaaagccaatctgtgcgcttgcgctttataaaaatccttaccgggaacattcgtaacgttttaaagcactatgatgagacgctcgctgtcgtccgccactgggataacatcgaagttcgcgcaaaagatgaaaaccagcgtctggctattcgcgacgctctgacccgtattccgggtatccaccatattctcgaagtcgaagacgtgccgtttaccgacatgcacgatattttcgagaaagcgttggttcagtatcgcgatcagctggaaggcaaaaccttctgcgtacgcgtgaagcgccgtggcaaacatgattttagctcgattgatgtggaacgttacgtcggcggcggtttaaatcagcatattgaatccgcgcgcgtgaagctgaccaatccggatgtgactgtccatctggaagtggaagacgatcgtctcctgctgattaaaggccgctacgaaggtattggcggtttcccgatcggcacccaggaagatgtgctgtcgctcatttccggtggtttcgactccggtgtttccagttatatgttgatgcgtcgcggctgccgcgtgcattactgcttctttaacctcggcggcgcggcgcatgaaattggcgtgcgtcaggtggcgcattatctgtggaaccgctttggcagctcccaccgcgtgcgttttgtcgctattaatttcgaaccggtcgtcggggaaattctcgagaaaatcgacgacggtcagatgggcgttatcctcaaacgtatgatggtgcgtgccgcatctaaagtggctgaacgttacggcgtacaggcgctggtcaccggcgaagcgctcggccaggtgtccagccagacgctgaccaacctgcgcctgattgataacgtctccgacacgctgatcctgcgtccgctgatctcttacgacaaagagcacatcatcaacctggcccgccagattggcaccgaagactttgctcgcacgatgccggaatattgtggtgtgatctccaaaagcccgacggtgaaagcagttaaatcgaagattgaagcggaagaagagaagttcgacttcagcattctcgataaagtggttgaggaagcgaataacgttgatatccgcgaaatcgcccagcagaccgagcaggaagtggtggaagtggaaaccgtcaatggcttcggcccgaacgacgtgatcctcgatatccgttctatcgatgaacaggaagataagccactgaaagtcgaagggattgatgtggtttctctgccgttctataaactgagcaccaaatttggcgatctcgaccagaacaaaacctggctgctgtggtgtgagcgcggggtgatgagccgtctgcaggcgctctatctgcgcgagcagggctttaacaatgtgaaggtatatcgcccgtaatttgtggtttttacgtcgcatctggtcagatgcgacgtttgccgcatccgacactactcgtaataattataaatccctgccgccatcaccagttgtgatgccacttcatgggctttttcacgcccaaccaacaggtcgataattttcagaccaaagtcgatagctgtacccggcccctggctggtcagcaattttacccgtgcatcccagacgacgcgcttgtccagccattgttcggcgggaattttgtctttcagcgtcgggaagccggtcatattaccaatcgggaagatatcgtgcggcaccagcacggtggctggcgcggcgcaaatagccgcgacgatacgcccggaacggtggaactgtttaacggtttcaaccagcagagtgctatcgcgaaaacactccgcgcctttaatgccaccaggcagcacgatcacgtcatattcgccatcagccacttcgaccagcggcgcatccgccagcagcttcacgccgcgcgagcaggtaatcgccaggttaccatcgctggcgacgctggcagtggtgactttgataccgccgcgaaccagcagatcgatagtggtgacggcttcagtctcttcactaccaggggcgaggcaaaccagtgccgatgcgctcatattcactctcctttctttttaccatttcaaacaggcgggtgttttccggtacggcaatcccatgcgcgcgggcgcggcgtaagagaaaaccattgatatagtcgatttcagtgtggcgcagcgcgcggatatcctgcaacatcgacgagatattttccgctgtggcatcaatcacctgcatcacgtaatcacgcaaatcttctgctgaagtatgatgcccttcgcgttcgatcaccgccgcgacttcttcgcatatctgcataatttcttgcggatgatgacgtaattcaccgttcgggcaattccagatggcagtcagtggattaatcacgcagttgactgccagcttgcgccacagctcggcgcgaatattgttatgccaggcaacgtcaggcaacacggtttgcaaaatatccgccagataactgtaatccccgtcctgttgccgtgccgggccaatatgcgtgataccgtttgccacatgaataatgacattgccgtcgcggcgggctgcatgggtggtggtgcccatcagtaatggctgctgaatgttttgcaactcttcgatggtgcccatgccgttgtgaattaacagtattggcgtagttacaggcagtgtggacgcgaggcttttgacggcatcggaaacctgccatgctttcagcgtcaccaggagcagatcgctggtggcgagaaaatcgggatcgttggcggtcagcgattcgttaaatatcgaaccatctgtctcaaccagattcacgctacaataaggttgcggtacgcgcagccagccctgaacttcatgaccctgtttgcaaagtgctgtaagccataattgccctaaggcaccgcatcccaatacggtaattttcattgttcctcctcacccgcaaccactccgggtgttcaataaggctatcccttaattgtgcatgctgttgcgactatgcacaattaagggatacgtcctggtgcaggactgtcggttatttaactttgcgggtattatgcttcgcatcaaaaatgaagggagaggaaaagatgccatctttcgatattgtctctgaagttgatcttcaggaagcacgtaacgcggtcgataacgcgagccgcgaagtggagtcccgttttgacttccgtaacgttgaagcctcatttgagctgaacgacgccagcaaaaccatcaaagtgttgagcgagtccgatttccaggtcaatcagttgctggatattctgcgtgccaagctgctgaagcgcggcattgaaggcagttcgctggatgtaccggagaatatcgttcatagcggtaaaacctggtttgtggaagcgaaactgaaacagggcattgagagcgcgacccagaagaaaatcgtcaagatgatcaaagacagcaaactgaaagtgcaggcgcaaattcagggcgatgaaatccgcgtaacgggcaaatctcgtgatgatttgcaggctgtcatggcgatggtacgtggtggcgatctcggtcagccgttccagttcaaaaacttccgcgattaatcgcgactatgtgcgttttgttcatgtcagatgcggcatgaacgcctgattcggcctacaaaggtttgtaattcagaaactttgtaggcctgataagcgtagcgcagcaggcaattcgccgcgttttttatgcctgacgaattgcctgttctatctcaaagcgattcgtcactttgctgtcgattttcacataagctgaatgttcttcttctgcaatcaacacttctttgatgccttcagtttctagcaaacgcacttttaacgcctcgtttgcggcaatgttcgccgggatttcaatgcgcaaactgctgacatacggcggttctttcatggtactggcgactgtcagccacactgcggccagcattgcgccagcgagaaataccccctgaccgtcaaacatgccgttaatccagccgcccagcgaaccgccaatcgccacgccaagaaactggctggtggagtaaacacccatcgccgtacctttgtaacctgctggcgactctttactgataagtgagggcaggagggcttccatcaaattaaacgccacaaagaaaagctgcacgccgaccaccagttgccagaactgcgtttgcgcgttccacaacacaatttccgcaaccacgatcaacccgacgcagaagacaaagacttgcttcattttgcgcttaacttcagcgtagataatgaaaggcacgaccgagccaaaggcgattagcattgtcgccagatagaccttccagtgttcagccgccgggaaccctgcatcagccagttgtccgggcagggcaacaaacgtcgacatcagcaaaatatgcagacacataatgccaaagttgagtttcagcagccgcggttccgccagcactttactgaaactgcctttcaccattccggactcacgattaagtacgtgagtgctactgttgggcacaacccaaatggtcaacgcaatgccggtcgttgccagaatagcgatcatccagaacagcgcgtgcagcccaagtttgtgagtgatgatcgggccaagcaccatcgcaatggcaaaggtaatgccaaagctcacgccgataaacgccatcgctttggtgcggttttgttcgcgcgtgagatcggaaagcagcgccataacggcggcggcaattgctccagagccttgtagcgcccggcccagaataattccccagatggagtcggaaagcgcagcgataacgctaccggcggcaaacaccgccagcccaccgacaattaatggtttgcgaccaatgcggtcggaaagcaggccaaacggaatctgaaaaacggcctgagtcagaccataaataccaatggcaataccgattaatgcttcgctggcaccttgcagagccatgccgtacgtggtcagaaccggcagaaccataaacatgcccagcatgcgcaacgagaatacggtccctaaaccccaggtcgcgcgcctctcacctggcgtcattttataatcgttcattaccacctctgttttaaattcgcgactagtgtaaagcggcaaacgaatggggtaaacatgcggattttttagtaaatatttcgagagggatatgtttctaatgctaagaaaaaaggtgccgtagcacctttttaatagagaggttttgttaccacacagcagccagcagcgtatgcgagtccggtaccataaaatcaacggacatcatcaccgagagggcagtgatggcgatgatagagaagccgaacagcttgcgcgcccagattctgtcatcagcaactttataaccgcgcagagccatacctaaccaccagacgctaaccgccgcggcgaccaccagatatttatacccagcgtaaccgccaagagagagcatcagcgtggcaacggcaaaggcgatgatatacagcgtgatgtgattcttcgccaccgaaatgccttttaccactggcaataccggaatgtttgccgcctggtaatccttaaagcggaaaatggcgatggcataggagtgaggcatctgccacaggctgaagatagccagcaggatcgctgcgccgctatcgaactcaccggttaccgcacagtagccgatcaccggcggcgcagcgccggagagcgaaccaatcaacgtgccgtagacagagtggcgtttcatgtacaggctataaacgccgacataaaccacaaagcccatcacccccagccagcaggccagcggattcgcgccaaaccacagcagcataaagccagcaatacccagcaacgtggcgtacaccagcgagacagcaggagagatcaggcctttcaccagcacccgattcttcgtcctttccatctttctgtcgatatccctgtcgatgtagttgttaaacacacaacccgacgccacaaccagtgacaccccaaccagcgtgtagataaacaggggataatcaatgctgccctttgaggccagcaggaatcccccaatcaccgagatcaggttgccaaagatgatgcctggtttcgttacttgcaggtattgcttaaacatcataaccgccgctcttagtgcatcatcatgttgtagttgaggttccacataatccagatggagcctacaaccaggatagcgatgattagcacggtgaagacaaacgccgtcatgttccagccttcatctgatttggtattcatgtgcaggaagcacaccagatgcaccagaacctgtaccactgccattgccaggattgttcccagaattacggccggagaggcagctcctgtcatcaccatccagaacggaatcaccgtcagaatgatcgacaggataaagcctgtcatgtaggtttttacgctgccatgggacgcgccgctgtgatcggtagaatgactcattacatcgcccccatcagataaacaacagtgaacacacagatccaaaccacatccaggaagtgccagaacaggctcaggcacatgatgcgggtacggttagtgctggtcaggccgcgacgggcgatttgcaccatcagcaccgccatccagataagaccagaagtgacgtgcagaccgtgcgtgccgaccagcgcaaagaacgctgacaggaagccgctgcgatccggacccatgccgttaacaatcaggtgatggaattcatagatttccatcccgataaatccggcaccaaacaaccaggtcaacgccagccaggagataacctggcttttgttgtttttgtacatggcgatagccgccatgccgtaggtgatggagctgaacaacagcaagaaagtttcaaccagaacgaacggcagttcgaaaatgtccttacctgtcgggccgcctgcggtgccgttcaccagaacggcataggtagcaaacaagatagagaacagaatgcagtcgctcatcaggtagatccaaaatccgaagattttggttccgcctgcatcgtggtgcccgtgttcgtgcgcgtgggcagtcgcgtgcgtcaaagtatcagttgccatttttcagccctgccttagtaatctcatcgaaatgctggttttccagtttttcgatttctgccaccggcacgtagtaatccacgtcctcgtcgaagcttttcacgatccaggtgatgatcatgcctgcgaagccaacaatcgccagccaccagatatgccagatcatggcgaaaccgaagatggtggagaaagctgcaatgacgatacctgcaccgctgtttttcggcatatgaatttcttcatagtggtcaggctttttatacgcttcgcctttctctttcatttcccagaatgcatcacgttcgtgaacgtgcggcactacggcaaagttatagaacggaggcggggaagaggttgcccactccagcgtacggccaccccacgggtcgccagtcaggtcacggttctggtcgcggtcgcgaatagaaacgtacatctgaataacgaggcagagaatacccagcgcaatcagtactgcaccgctggctgcaatcatcagcatggtgtggaactgcgggtcaatctgctggctcaaacgacgggtcatgcccatgaagcccagcgcatacagtggcataaaggcaacgaagaagccgatgatccagaaccagaacgcgcgtttaccccaggtttcgttcagtttgaaaccgaacgctttaggccaccagtaggtcatccctgcgaagcagccgaagaccacgccgccgatgatcacgttatggaagtgcgcaatcaggaacaggctgttatgcagaacgaagtccgcgcccggtacggccagcagcacgccagtcatcccgcccaccgagaaggtgacgataaaaccgatggtccacagcatcgcagaatggaacacgatgcggccctgatacatggtgaacagccagttgaagatcttcaccccggtcgggatggcgataatcattgtggtgataccaaagaaggcgtttacgttcgcgcccgcacccatcgtaaagaagtggtgcagccaaacgatgaacgacagcacggtgatacagacggttgcccataccagcgaggtataaccaaacagacgtttacgcgagaaggttgccgcaatttcggagaacacaccgaaaacaggcaggatcaggatgtaaacttccgggtggccccaggcccaaatcaggttgatgtacatcatcatgttgccacccatatcgttggtaaagaaatgggtgcccagatagcgatccagggtcaacaacgcgacggtaaccgtcagaattgggaaggaagcaataatcagtacgttcgcgcacagtgatgcccaggtaaatactggcatcttgaacatggtcatgcccggtgcgcgcatcttcagaatggtaacgaagaagttgataccggtaagcgtcgtacctataccggatagctggagactccatatccagtaatcgacaccgactcccggactgtactctattcccgatagcggtggataggccagccagccggtctgcgcaaattcgcccacgccgagagaaacgttaaccagaatcacaccaacaacggtaaaccagaagcttaagttgttgaggaacgggaacgcaacgtcacgcgcgccgatctgcagcggaaccaccaggttcatcagaccgataacgaaaggcatcgccacgaagaagatcataatcacgccgtgcgcggtaaagatctgatcgtagtggtgaggtggcaggaagcccgcttcgcccgccgaggcaagagcctgctggctacgcatcataatggcgtcagcaaaaccacgcagcaacatcacaatcgccacgatgatatacatgataccgaggcgtttatggtcgacggaggtcagccactctttccacaggtaggtccacttaccgaagtaagtgatcaggccaacgagcgccagacctcccaaaataatgccagcgatcgtaaccatgacgataggttcatggaacgggactgcatcaagtgataattttccgaacatctttattcttcctcaacccctttaatgggcggattccgcgtggctcatgtccatgccttccataccttcgtgtgcgctgtgctcaccttctggctgggtcatgtccatgctcttaccgtgagccataaacttgttaattacatcggcaaacaagtctggtttcacgttggagaaatattccacctggttgtattcgctaggcgcggccagtttttcgaacgcagccatgtcagacatggtgttcggcgactgcttcgcttttgcgacccactggtcgaatgcggcgcgatccggtgttgcaatagctttgaacttcatgcctgagaagcccgggccgctgtagctggcggagataccgtcataagtgccgggttcgttggcgatcagatgcaggcgagtctgcataccggccatggcataaatctggctacccagacgcggaatgaagaaggagttcatcacggagttggaggtcactttgaagtacaccggagtgttcgccgggaaagcgatttcattcacggtagcaatgccctgttccgggtagatgaagaaccatttccagtccatggaaaccacttcgatggtaatgggcttctcgtcgtgtgccagcggcttgctaggctcaagagcgtgagtggttttccaggtcagtactgcaaggaagatgatgattaagataggtaccgtccagaccacagcttccactttattggagtgtgaccagttcgggctgtacttagcatctttattgctcgcacggtacttccaggcgaaaccaacagccatcaagattgcgggaataacgacaatcaacatcaggccaaatgccgtcagtatcagtgaacgttgctccagaccaatctgtcctttgggatctaacagcgcagaattacagccactgagcaatacagtgcctgcaaataatgacaaccatcccaaacttttattgtatttcctgagtctcatttaacgacctcaattccacgggatctggtggcgtttaaagtgtgtgggcattttacgggaaggttacattactgtaaacatgattaaattcctgttacttggatttggctgccaggtcacatatgttgcaaaacatatcaggttgattttaagaagctgttgcaaaagggcgttataacaaaaggggagtgctgaaggagtctgggcgggcaattggtataaccaatgtgaaataaaacaattatttaacaaataattatcattagagtgacaactgggtgatgagaaaataaagactcattagctgaatcgtgtaagaaaaatagaatttataaatggcgccaataatttccaaacgctaagccgcacaaaagaacaaatattaataagcgatactgatgtttatttagccgtaataattacggcgagtgattactacagctaaataatatttacagattacgtcagatgcgtttttcgtagcgccagataatccagcaaaccaccaagcacgacgccagaaagggcgactaaaaccccgacttccagcagagcaggcaggaaagagaagtgcgtcaaatccagcgcgtccatcgtcaatagcagtaaccacacggccaacaggctgacgcccgccgccagtgtccacatggcaaaggcataacctgccggatatgcggtacgggagataaagttgtcatttactcgtgtatattcaagcgtctggcggcaaaccagcagcaaaataagccctggtacggcagcggcgacggagaatagatagaatgtcgaccagccgtgtgcttcaacaaaccaacccgccacggggccgacataaactcgccctacagcagaaagcgctgagagcagggcaaattgagtagcggaaaatgacttattacatagcgtcattaacagcgcgacaaaggctgatgtgcccatcccgccacagaggttttcgaaaaagacggctgcgcccatgctgtagagatgcttatcagtaatcgacagcagccagtaaccggcgttagacgcaccttgtaaaatgccgaaaatcagcagtgcccggaacagtgacaggcgctgcatcaaaatcccaccgtacaatgcgccaacaatggtcgctagtaagccaagcgttttgttaaccacgcctacttcacccgcatcaaacccgacgccgcgaatcaaaaacgtggttgtcaggctcatggcgaatgcgtcgcccagcttatacagcacgataagaagcaaaataagccaggcattattgcgaccaaagaaatctcgcagaggtgcaacaaccgcttgttccagcgttttgggcacaggaatggtgtcggttggttctggtgcaagcaacgtcgcgataatacaggggatcaacagtgccgccattaaccagtacatgccctgccagcccagccatttatctgccagccacagggctaggccgccggaaaccagcatccctaaacggtaacccagcacgctgattgccgcgcccgcaccacgttcttctgccggaagcacatcggttttccacgcatcgaagactatatcctgggaagcagagcaaaaagcgatcaccactgccagcgccgccatccagcggagttgggtgcctggttcgagaaaacccatcgccgcaatggcgactaataacaggatttgcgtggcgagcagccaaccgcgccgccgcccaaaaaatggaggcgtgtagcggtccatcagcggtgaccagaggaatttaaaaacgtaagcctggcctaccagagagaagaaaccaatggttttgagatcgatattctcgaccgtcatccaggcctgtaaggtaccggatgtcagggcgagcggtagcccggaagcaaaacccaggatcagcaatatggctgaacgcggctgttgaaaaatacgtaaatattgactggacatgggcgtctacaggcccggcttgcaccgggccagagggcagaaattaacgcgcgttctgcttgatgaattcgtggatgctggtgtcctgagacatatcagcgatggtatcggtcagcacactgttaaccgcatcggcgatatttttgttggaggcctggaacgcaccttcaacgttgtagctggcacgatagtttttggtcattttgttgccattctgcgcggtagcgatgatggcgatatccgctttggtcgcgatgttgtagcgcacgttgccctgggacacgtcagcatacagttggctaacgatgatttgcagattaaccgggccattcggaccaaccatgtaaccacgcgcggtcatctgtttttccagcacttcttgcagcaggaaacgcagatcgcgggaggcggtcagggtaacgatttgattatcgcgggtgacttttgccagcgcctgatcggtacgctgatcggcaccattaatgcttacggtgacgcccatcaggcttggatcctgctgtggcagtgtaatcgtcggggaaacttcaatagttgttggcggttttgcgcatcctgcaagcataaacagagcaactaacgggaagaggatttttttgaacatgttcgggctctcagagactcttaagcgtgtttggtaaaaattcccgccatcataacattgccaacggcgaggggaagtgggtaaggcatgtaaattcatcatgttgacgaaataatcgcccctggtaaaagaaacactgatgcgaggcctgtgtttcaatctttaaatcagtaaacttcatacgcttgacggaaaaaccaggacgaaacctaaatatttgttgttaagctgcaatggaaacggtaaaagcggctagtatttaaagggatggatgacatctcagcgttgtcggaggagatatttcatgatgatacgtgagcggatagaagaaaaattaagggcggcgttccaacccgtattcctcgaagtagtggatgaaagctatcgtcacaatgtcccagccggctctgaaagccattttaaagttgtgctggtcagcgatcgttttacgggtgaacgttttctgaatcgtcatcgaatgatttacagtactttagcggaggaactctctactaccgttcatgcgctggctctgcatacttacactattaaggagtgggaagggttgcaggacaccgtctttgcctctcctccctgtcgtggagcaggaagcatcgcgtaaaaacgcatttgcaactgtcggcgcttttccagtatgttgctaaagattttatgaaaaacggcctgcgggccgttttgttttgtctggattttgcgctttttgcccagcattcagacgaaaattgcccgggaattgtgaaaaaatacgcgacagcgcgcaataaccgttctcgactcataaaagtgatgccgctataatgccgcgtcctatttgaatgctttcgggatgattctggtaacagggaatgtgattgattataagaacatcccggttccgcgaagccaacaacctgtgcttgcggggtaagagttgaccgagcactgtgattttttgaggtaacaagatgcaagtttcagttgaaaccactcaaggccttggccgccgtgtaacgattactatcgctgctgacagcatcgagaccgctgttaaaagcgagctggtcaacgttgcgaaaaaagtacgtattgacggcttccgcaaaggcaaagtgccaatgaatatcgttgctcagcgttatggcgcgtctgtacgccaggacgttctgggtgacctgatgagccgtaacttcattgacgccatcattaaagaaaaaatcaatccggctggcgcaccgacttatgttccgggcgaatacaagctgggtgaagacttcacttactctgtagagtttgaagtttatccggaagttgaactgcagggtctggaagcgatcgaagttgaaaaaccgatcgttgaagtgaccgacgctgacgttgacggcatgctggatactctgcgtaaacagcaggcgacctggaaagaaaaagacggcgctgttgaagcagaagaccgcgtaaccatcgacttcaccggttctgtagacggcgaagagttcgaaggcggtaaagcgtctgatttcgtactggcgatgggccagggtcgtatgatcccgggctttgaagacggtatcaaaggccacaaagctggcgaagagttcaccatcgacgtgaccttcccggaagaataccacgcagaaaacctgaaaggtaaagcagcgaaattcgctatcaacctgaagaaagttgaagagcgtgaactgccggaactgactgcagaattcatcaaacgtttcggcgttgaagatggttccgtagaaggtctgcgcgctgaagtgcgtaaaaacatggagcgcgagctgaagagcgccatccgtaaccgcgttaagtctcaggcgatcgaaggtctggtaaaagctaacgacatcgacgtaccggctgcgctgatcgacagcgaaatcgacgttctgcgtcgccaggctgcacagcgtttcggtggcaacgaaaaacaagctctggaactgccgcgcgaactgttcgaagaacaggctaaacgccgcgtagttgttggcctgctgctgggcgaagttatccgcaccaacgagctgaaagctgacgaagagcgcgtgaaaggcctgatcgaagagatggcttctgcgtacgaagatccgaaagaagttatcgagttctacagcaaaaacaaagaactgatggacaacatgcgcaatgttgctctggaagaacaggctgttgaagctgtactggcgaaagcgaaagtgactgaaaaagaaaccactttcaacgagctgatgaaccagcaggcgtaatttacgcagcataacgcgctaaattcgcacaaaggcccgtcaccgccaggtggtgggcttttttttgtcatgaattttgcatggaaccgtgcgaaaagcctctttcggtgttagcgtaacaacaaaagattgttatgcttgaaatatggtgatgccgtacccataacacagggactagctgataatccgtccataaggttacaatcggtacagcaggttttttcaattttatccaggagacggaaatgtcatacagcggcgaacgagataactttgcaccccatatggcgctggtgccgatggtcattgaacagacctcacgcggtgagcgctcttttgatatctattctcgtctacttaaggaacgcgtcatttttctgactggccaggttgaagaccacatggctaacctgattgtggcgcagatgctgttcctggaagcggaaaacccagaaaaagatatctatctgtacattaactccccaggcggggtgatcactgccgggatgtctatctatgacaccatgcagtttatcaagcctgatgtcagcaccatctgtatgggccaggcggcctcgatgggcgctttcttgctgaccgcaggggcaaaaggtaaacgtttttgcctgccgaattcgcgcgtgatgattcaccaaccgttgggcggctaccagggccaggcgaccgatatcgaaattcatgcccgtgaaattctgaaagttaaagggcgcatgaatgaacttatggcgcttcatacgggtcaatcattagaacagattgaacgtgataccgagcgcgatcgcttcctttccgcccctgaagcggtggaatacggtctggtcgattcgattctgacccatcgtaattgatgccagaggcgcaactgtgccgctatacttatccagggcggcacaacgctgtaagcggcttgcgcctgagaatggcatttgcgtcgtcgtgtgcggcacaaagaacaaagaagaggttttgacccatgacagataaacgcaaagatggctcaggcaaattgctgtattgctctttttgcggcaaaagccagcatgaagtgcgcaagctgattgccggtccatccgtgtatatctgcgacgaatgtgttgatttatgtaacgacatcattcgcgaagagattaaagaagttgcaccgcatcgtgaacgcagtgcgctaccgacgccgcatgaaattcgcaaccacctggacgattacgttatcggccaggaacaggcgaaaaaagtgctggcggtcgcggtatacaaccattacaaacgtctgcgcaacggcgataccagcaatggcgtcgagttgggcaaaagtaacattctgctgatcggtccgaccggttccggtaaaacgctgctggctgaaacgctggcgcgcctgctggatgttccgttcaccatggccgacgcgactacactgaccgaagccggttatgtgggtgaagacgttgaaaacatcattcagaagctgttgcagaaatgcgactacgatgtccagaaagcacagcgtggtattgtctacatcgatgaaatcgacaagatttctcgtaagtcagacaacccgtccattacccgagacgtttccggtgaaggcgtacagcaggcactgttgaaactgatcgaaggtacggtagctgctgttccaccgcaaggtgggcgtaaacatccgcagcaggaattcttgcaggttgatacctctaagatcctgtttatttgtggcggtgcgtttgccggtctggataaagtgatttcccaccgtgtagaaaccggctccggcattggttttggcgcgacggtaaaagcgaagtccgacaaagcaagcgaaggcgagctgctggcgcaggttgaaccggaagatctgatcaagtttggtcttatccctgagtttattggtcgtctgccggttgtcgcaacgttgaatgaactgagcgaagaagctctgattcagatcctcaaagagccgaaaaacgccctgaccaagcagtatcaggcgctgtttaatctggaaggcgtggatctggaattccgtgacgaggcgctggatgctatcgctaagaaagcgatggcgcgtaaaaccggtgcccgtggcctgcgttccatcgtagaagccgcactgctcgataccatgtacgatctgccgtccatggaagacgtcgaaaaagtggttatcgacgagtcggtaattgatggtcaaagcaaaccgttgctgatttatggcaagccggaagcgcaacaggcatctggtgaataattaaccattcccatacaattagttaaccaaaaaggggggattttatctcccctttaatttttcctctattctcggcgttgaatgtgggggaaacatccccatatactgacgtacatgttaatagatggcgtgaagcacagtcgtgtcatctgattacctggcggaaattaaactaagagagagctctatgaatcctgagcgttctgaacgcattgaaatccccgtattgccgctgcgcgatgtggtggtttatccgcacatggtcatccccttatttgtcgggcgggaaaaatctatccgttgtctggaagcggcgatggaccatgataaaaaaattatgctggtcgcgcagaaagaagcttcaacggatgagccgggtgtaaacgatcttttcaccgtcgggaccgtggcctctatattgcagatgctgaaactgcctgacggcaccgtcaaagtgctggtcgaggggttacagcgcgcgcgtatttctgcgctctctgacaatggcgaacacttttctgcgaaggcggagtatctggagtcgccgaccattgatgagcgggaacaggaagtgctggtgcgtactgcaatcagccagttcgaaggctacatcaagctgaacaaaaaaatcccaccagaagtgctgacgtcgctgaatagcatcgacgatccggcgcgtctggcggataccattgctgcacatatgccgctgaaactggctgacaaacagtctgttctggagatgtccgacgttaacgaacgtctggaatatctgatggcaatgatggaatcggaaatcgatctgctgcaggttgagaaacgcattcgcaaccgcgttaaaaagcagatggagaaatcccagcgtgagtactatctgaacgagcaaatgaaagctattcagaaagaactcggtgaaatggacgacgcgccggacgaaaacgaagccctgaagcgcaaaatcgacgcggcgaagatgccgaaagaggcaaaagagaaagcggaagcagagttgcagaagctgaaaatgatgtctccgatgtcggcagaagcgaccgtagtgcgtggttatatcgactggatggtacaggtgccgtggaatgcgcgtagcaaggtcaaaaaagacctgcgtcaggcgcaggaaatccttgataccgaccattatggtctggagcgcgtgaaagatcgaatccttgagtatcttgcggttcaaagccgtgtcaacaaaatcaagggaccgatcctctgcctggtagggccgccgggggtaggtaaaacctctcttggtcagtccattgccaaagccaccgggcgtaaatatgtccgtatggcgctgggcggcgtgcgtgatgaagcggaaatccgtggtcaccgccgtacttacatcggttctatgccgggtaaactgatccagaaaatggcgaaagtgggcgtgaaaaacccgctgttcctgctcgatgagatcgacaaaatgtcttctgacatgcgtggcgatccggcctctgcactgcttgaagtgctggatccagagcagaacgtagcgttcagcgaccactacctggaagtggattacgatctcagcgacgtgatgtttgtcgcgacgtcgaactccatgaacattccggcaccgctgctggatcgtatggaagtgattcgcctctccggttataccgaagatgaaaaactgaacatcgccaaacgtcacctgctgccgaagcagattgaacgtaatgcactgaaaaaaggtgagctgaccgtcgacgatagcgccattatcggcattattcgttactacacccgtgaggcgggcgtgcgtggtctggagcgtgaaatctccaaactgtgtcgcaaagcggttaagcagttactgctcgataagtcattaaaacatatcgaaattaacggcgataacctgcatgactatctcggtgttcagcgtttcgactatggtcgcgcggataacgaaaaccgtgtcggtcaggtaaccggtctggcgtggacggaagtgggcggtgacttgctgaccattgaaaccgcatgtgttccgggtaaaggcaaactgacctataccggttcgctcggcgaagtgatgcaggagtccattcaggcggcgttaacggtggttcgtgcgcgtgcggaaaaactggggatcaaccctgatttttacgaaaaacgtgacatccacgtccacgtaccggaaggtgcgacgccgaaagatggtccgagtgccggtattgctatgtgcaccgcgctggtttcttgcctgaccggtaacccggttcgtgccgatgtggcaatgaccggtgagatcactctgcgtggtcaggtactgccgatcggtggtttgaaagaaaaactcctggcagcgcatcgcggcgggattaaaacagtgctaattccgttcgaaaataaacgcgatctggaagagattcctgacaacgtaattgccgatctggacattcatcctgtgaagcgcattgaggaagttctgactctggcgctgcaaaatgaaccgtctggtatgcaggttgtgactgcaaaatagtgacctcgcgcaaaatgcactaataaaaacagggctggcaggctaattcgggcttgccagcctttttttgtctcgctaagttagatggcggatcgggcttgcccttattaaggggtgttgtaaggggatggctggcctgatataactgctgcgcgttcgtaccttgaaggattcaagtgcgatataaattataaagaggaagagaagagtgaataaatctcaattgatcgacaagattgctgcaggggctgatatctctaaagctgcggctggccgtgcgttagatgctattattgcttccgtaactgaatctctgaaagaaggggatgatgtagcactggtaggttttggtacttttgccgttaaagagcgtgctgcccgtactggccgcaacccgcagaccggtaaagagatcaccatcgctgctgctaaagtaccgagcttccgtgcaggtaaagcactgaaagacgcggtaaactaagcgttgtccccagtggggatgtgacgaagttcaagggcgcatctactgatgtgccttttttatttgtattcggtgactttctgcgtcttgtgggctgacaattgcccccgtttcttgtcacaataggcctttgcgcgcatcgatacgttgcgtgaggtacacagtcatctacagcggagtgttgttacaccatgatggacagcttacgcacggctgcaaacagtctcgtgctcaagattattttcggtatcattatcgtgtcgttcatattgaccggcgtgagtggttacctgattggcggaggcaataactacgccgcaaaagtgaatgaccaggaaatcagccgtgggcaattcgagaacgccttcaacagcgagcgtaatcgcatgcagcaacagctgggcgatcaatactccgagctggcagcgaacgaaggctatatgaaaaccctgcgtcaacaggtgctgaatcgtctgatcgacgaggcgctgctggatcagtacgcacgtgagctgaaactgggtatcagcgatgagcaggttaaacaggcgattttcgcgaccccagccttccaggttgacggcaaatttgataacagccgctataacggtatcctcaaccagatggggatgaccgccgatcagtacgcccaggcgctgcgtaaccagctcactacccaacagctgattaacggcgttgccggtaccgattttatgctgaaaggtgaaaccgacgagctggcggcactggtcgcgcaacaacgcgtggtgcgtgaggcgactatcgatgttaacgcgctggcggcgaagcagcctgtgaccgaacaggagattgccagctactacgaacaaaacaaaaacaatttcatgacgccggaacaattccgcgtgagttacatcaagctggatgccgcaacgatgcagcaaccggttagcgatgcggatatccagagctactacgaccagcatcaggatcaattcacccagccgcagcgtacccgctacagcatcatccagaccaaaactgaagatgaagcgaaagcggtacttgatgagctgaataaaggcggtgattttgctgcattagccaaagaaaaatctgccgatattatctctgctcgtaacggcggcgatatgggttggttagaagatgccactatcccggacgaactgaaaaatgctggtctgaaagaaaaaggccaactgtctggtgtcatcaaatcttcggtcggtttcctgattgtacgtctggacgacattcagccagcgaaagtgaaatcgttagacgaagtacgtgacgacattgcggcgaaagtgaaacacgaaaaagccctcgatgcgtactacgcgctgcagcagaaagtgagcgatgcggcaagcaacgacaccgagtctctggccggtgcagagcaagctgccggcgttaaagccactcagacgggttggttcagcaaagataacctgccggaagagttgaacttcaagccggttgccgacgctatctttaacggcggtctggtaggtgaaaacggcgcgccgggcatcaactctgacatcatcaccgtagacggcgaccgcgcattcgtgctgcgcatcagcgagcacaaaccggaagcggtgaaaccgttggcagatgttcaggaacaagttaaggcattggttcagcacaacaaagctgaacaacaggcgaaagtggatgctgagaaactgctggttgatttgaaagccggcaaaggtgcggaagctatgcaggctgccggtctgaaatttggcgagccgaaaaccttaagccgttccggtcgtgacccgattagccaggcggcgtttgcactgccactgccagcgaaagacaaaccgagctacggtatggcgaccgatatgcaaggtaatgtggttctgctggcgctggatgaagtgaaacaaggttcaatgccggaagatcagaaaaaagcgatggtgcagggtatcacccagaacaacgcacaaatcgtctttgaagctctgatgagtaacctgcgtaaagaggcgaaaatcaaaattggcgatgcgctggaacagcaataatcctgaagccgcctcgcaaaaaaatgcgttgcagctgtaacaagaaaaggtcgctttcgcggccttttccatttctgaacattgccatttgtttactgttttcactgccgttaaggtgattccactgttaacaaacaaggagaaaacagtatgaaacacggaattaaagcactgctcattaccctgtccctggcctgtgccggaatgtctcatagcgcgctggcggcagcttctgtggcgaaaccgacggcggtagaaaccaaagcggaagctcctgcagcacaaagtaaagcagcagtaccggcgaaagccagtgacgaagaaggcacccgggtcagcattaataatgccagcgcggaagagctagcccgcgcgatgaatggcgttggcctgaagaaagcgcaggcgattgtcagttatcgcgaagagtacggtccgtttaaaactgtggaggatctaaagcaggtgccggggatgggcaattcgctggtggaacgtaatctggcggtattaaccctgtaattaatttgcatagtggcaattttttgccagactgaagaggtcataccagttatgacctctgtacttataacaacaacgtaaggttattgcgctatgcaaacacaaatcaaagttcgtggatatcatctcgacgtttaccagcacgtcaacaacgcccgctaccttgaatttctcgaagaagcccgctgggatgggttggaaaatagcgacagttttcagtggatgacggcccataacatcgccttcgtcgtggtcaatatcaatattaactatcgtcgcccagcggtattaagtgacctgttaactattaccagtcagttgcagcaattaaacggtaaaagcggcatcttaagccaggtcattacactggagccggaagggcaggtggtagcggatgcgcttattacgtttgtttgtattgatcttaaaacgcagaaagcattagctctggaaggggaattgcgcgaaaagctggagcagatggttaagtaaacgttttgtggtgccggatgctcaagccgcatccggcgacacccggaataattacctcaacccggttttctgcttcatcgctgccatcaccgtcggtttatcggccagataatgattcaaaccgttggcgcgtaaattacatgccgcacaatgaccgcaaccgtcgcctttaaagccgttatagcaggtcaacgtttcgttacggactaaatccagtttgccgtaataatctgccagcgcccaggtttccgctttatcaatccacatcagcggcgtttcaaaacgaatatctttcgccatgcccaaactgacggcatggtttagtgctttcacaaactcatcgcggcaatccgggtagccggagaaatccgtttcgcagacgccagtaattacggcttctgcttttacctgatacgcatatattgccgccagcgtcaggaacaaaatattacgccctgggacaaacgtattcgggataccatcggcttcaggttcataatcaggcaccggaatgctgtcacgcgtcaggctactgaccgccagctcgttgagcagggtgacatccagcaccttatgcgcgcgtgcccccagtttcagcgccagttcgcgtgccacgtcgatttctgcgcgatgccgctgaccgtaatcgaacgtcacgcaatggacttcatcatattgttgtaatgcctgcaccagacaggtggtggaatcctgacctccactgaacacaacgacagcacgtttcatagataatcctgcttgaacaataaaagcgttatggtaacgcctgcgattaacccggaccagctattcattgcgatggcgcgggaagccaggcttcggtaaattcaaaccagccgcgcggtgtcagtcgcacaccgttcacgccgggaggggcactaatgcgatagtgatagttgaacagcggcgtcagcgtcgcatctgtcattaactggctaaaaaccgctttcagggcattaaatcggttttcttcatcaggcattatttgcacggcatccagtgtcgattgtagatgtgcgtatgctggagcgtcgaaaacatgtggccacagcggatcgcagcgcagccattgctccagagtatattccggtgcttcgccaattaatctgtcgcccatcatgaggtctgcgtgtgcctgtagggtcgtgtcgtcccagttttttgcgttatgaaaaataattgtgagttcacagccttccgctgccagtgtcgcctgtaggcgttctgccatggtatgaagttctatcggtaggtgataaaccagcgtcaaggttttcggtagtttgacttcatccggtacctgccaatgcggaatagtccagcctggcagtaatgcatgactggcggtgatcaggttttctccgacttctaacgtttgtaataaaccggattgatgaataatggagatcacttttcgcgcctgccagagggagagtcggggacttttgcgcaacgtcaaatagcaaaaacctaaactgatgccgctactgacctggctgacccgttgcagctcctccggtttgccgatggtgatttgcacgggatgccgacaactggttcccaaatctttttcgaaaagcggcggagttatccagtactcaaccgctttaagcagcggatgacgtaaatggtaataatcatggctttccaggcgcaccagctctgctgtgaattgtgttaagcgaaaaggacccgtgccgatcagtgggaattgcggatgcgccagatggctgcaatagctcgccagccggtgcgcaagccagtaatcagggcgatgtaaaaagaaggtcagacactgcggatgggtgacttcaatacgcttcacgctaataaataattgatccagtgctggcagttgtaacagcatcaataatcgctggtgtaagtgtgaggcttttactgcatcgccgttatgccagtgtagggttgaacgaagataaaagtcccagcgtaacccgtcagtagaggtttcccagtgatgcgctaaatcgccaatcgggcgctgagtattattatcgaagcgggtcaggccggaaaatatctgcccggcgagatgctgctcggcacggccgggcaaaaagcctggttgtagcggttcgagcgggcgatagtagggaatacgcaacgtgggtgtatcgttttgccattgtccgcccataaacggctgtaacagagtgcgcagctcacctggggccagttgcgccagctccagcacatcttgctgctttccggtttccagtgcctgttccatcatcgcattgcgtagcgattccggcgtgaccagaaagcgtaattgtccgcgctttccgcgtcctgactgcgcctgccactccagccatcccgcctcctgtgcctgacgcaacagcgtacgaacatggcgttcgctgcaaaaacagcgttcggccagttcgctgacggtgacggtttgcggctttccggcggaaggttgccacagacgttgatactggttaagacggttgagcaatcgcatataaacccggaacaatattatttaactattcactattacttccgtatatatcaggtgatactcaatcaccattaaccgtgtcacagagtggagaaagaaatggctcgtctggcagcatttgatatggatggcactttattgatgcccgaccatcatttaggtgagaaaaccctctctactttggcgcgactgcgtgaacgcgacattaccctcacttttgccacggggcgtcatgcgctggagatgcagcatattctcggggcgctatcgctggatgcgtatttgattaccggcaacggaacgcgcgtgcattctctggaaggtgaacttttacatcgtgatgatttacctgcggatgtcgcggagctggtgctgtatcagcaatgggatacccgagccagcatgcatatcttcaatgacgacggttggtttaccgggaaagagatccctgcgttgttgcaggcatttgtctatagcggttttcgttatcagataatcgatgtcaaaaaaatgccactcggcagcgtcaccaagatctgcttctgtggcgatcacgacgatcttacacgcttgcagatccagctatacgaagcattaggcgagcgtgcacatttgtgtttttccgccacggattgcctcgaagtgctgccggtgggctgcaataaaggcgctgcattgacggtgctgacccaacatttaggtttatcgttgcgcgattgcatggcctttggtgatgcgatgaacgatcgcgaaatgttagtcagcgtcggtagcggatttattatgggcaatgcgatgccgcaactgcgcgcggagctcccgcatttaccggtgattggacattgccgaaatcaggctgtctctcactatttgacgcactggctggactatccacatctaccttattcccccgaataacgagatcccttccagcaccgggcaattgcccggttttttttgcgttgaatttgtcattttgtgccgtggtgtttaaaccgcacagaataaattgtcgtgatttcacctttaaaataaaattaaaagagaaaaaaattctctgtggaagggctatgttagataaaattgaccgtaagctgctggccttactgcagcaggattgcaccctctctttgcaggcactggctgaagccgttaatctgacaaccaccccttgctggaagcgcctgaaacggctggaggacgacggtatccttatcggcaaagtcgccctgctggatccggaaaaaataggcctcggcctgaccgcttttgtgctgataaaaacgcaacatcacagcagcgaatggtattgccgctttgtcacggtggttaccgaaatgccagaagtgctggggttctggcgcatggctggtgaatacgattatctgatgcgcgtccaggttgccgacatgaaacgctacgacgagttttataagcgtctggtaaacagcgtgccggggctgtcggacgtcacttccagcttcgcgatggaacagattaaatacaccacttctttacccatcgaataaatatccagaatcaggtcaggacacaacgcgtgcgattatttgctcaattaagctggtatttccgtcgggaatggcgtcgctatctcggggctgtcgccttgcttgtcattatcgcgatgctgcaactggttccgccaaaagtggttggtattgttgtcgatggcgtgacagaacaacactttactaccgggcagatcctgatgtggatcgccaccatggtgctgattgccgttgtggtttatctcctgcgttacgtctggcgggtattgctgtttggtgcgtcttatcaactggctgttgaactgcgtgaagattattaccgtcagctaagccggcagcatcctgagttttacctgcgtcatcgcaccggtgacctcatggctcgtgcgaccaatgacgtcgatcgcgtcgtgtttgccgccggagaaggggtgctgacgctggtggattcactggtgatgggctgcgctgtgttgattatgatgtctacgcaaattagctggcagttgaccttattttccctgttgccgatgccagtgatggcgatcatgattaagcgcaacggcgatgctttgcatgaacgctttaagctggcacaggcggcgttttccagtcttaatgaccgcacccaggaaagcctcaccagtatccgcatgatcaaagcctttggtctggaagatcgccagtcggcgttatttgccgcggatgccgaagataccggcaaaaaaaacatgcgggtggcgcgtattgatgctcgtttcgacccgaccatctatatcgcgattggtatggcgaacttgctggcgattggcggcggtagttggatggtggtgcagggcagtttaacgctgggccagctcaccagttttatgatgtatttaggtctgatgatttggccaatgctggcgctggcatggatgtttaacattgtggaacgtggtagtgctgcgtacagccgtattcgcgcgatgctggcggaagcgccggtggtgaacgatggtagcgaacccgtgccggaagggcgtggcgaactggatgtaaatattcaccagttcacgtatccgcagactgaccatcctgcgctggaaaacgtcaatttcgccctgaaacccggtcagatgctgggtatctgcgggccgactggttccggcaaaagtaccctgttgtcgctcattcagcgtcatttcgacgtcagcgagggggatattcgctttcatgatattcctctgacgaagttacaactcgatagctggcgtagccgcctggcggtagttagccagacgccattccttttttctgacactgtggcgaataacatcgcgctgggttgcccgaatgccacccagcaagagattgagcatgtcgcgcggttagccagcgtacatgacgatattttgcgtctaccgcaaggttacgatacagaggtgggcgagcgcggtgtgatgctttccggcgggcaaaaacagcgtatctccattgctcgtgcgttattagtcaacgcggaaatcctcatccttgatgatgcgctttcggcggtggacggacgcactgagcaccagatcctgcataacctgcgtcagtgggggcagggaagaacggtaatcatcagtgcccatcgcctttctgcactgacggaagccagtgaaattattgtgatgcagcacggacatatcgcccagcgtggcaatcatgatgtgctggcacaacaaagcggctggtatcgcgatatgtatcgctatcaacaactggaggcggcgctcgacgacgctccggaaaatcgcgaggaggccgtcgatgcgtagttttagccaactgtggccgactctcaagcgcctgttagcgtacggttcgccgtggcgtaaaccgctggggattgcggtcctgatgatgtgggttgcggcggcggcagaagtcagtgggccgctgcttatcagctattttatcgacaatatggtagcgaaaaataacctgccgttgaaagtggttgcagggctggctgcggcgtatgttgggctgcaactgtttgccgccgggctacattacgcgcagtcgctgctgtttaatcgggcggcagtaggcgtagtgcaacagttgcgtaccgacgtgatggatgctgcgttacgccagccattaagcgagtttgatacccaacccgtcgggcaggtgatttcccgcgtcactaatgacactgaagtgatccgcgatctctacgttaccgtagtggcaactgtcctgcgcagtgccgcgctggtgggcgcgatgctggtggcgatgttcagcctcgactggcgaatggcactggtggcgataatgattttcccggtggtgctggtggtaatggtgatataccagcgttacagcacgccgattgtccgtcgtgtgcgcgcctatttggcggatatcaacgacggctttaacgaaatcatcaatggcatgagcgttatccagcagtttcgtcagcaggcgcgatttggcgaacgtatgggggaggccagtcgttcacactatatggcgaggatgcaaaccctgcgcctcgacggttttctgctgcgtccgctgctgagtctgttttcatcgctcattctttgtggcttgttgatgctgtttggcttctccgccagcggcaccattgaagtgggcgtgctgtatgcgtttatcagctatcttgggcgacttaacgaaccattaatcgaactgaccacgcaacaggcgatgctgcaacaggctgttgttgctggtgagcgcgtgtttgaactgatggacggaccgcgccagcaatatggcaatgatgatcgcccgttacagagtggcaccatcgaagtcgataacgtgtcatttgcttatcgcgatgacaatctggtgctaaagaacattaatctctctgtgccttcgcgcaattttgtggcgctggtcgggcataccggcagtggcaaaagcaccctcgccagtttattgatgggctattacccgctaacggaaggtgagattcgccttgatggtcgtccattaagttcgctaagtcacagcgcgctgcgccagggcgtggcaatggtgcagcaagatccggtggtgctggcggataccttcctcgccaacgtgacgctggggcgggatatctccgaagaacgcgtctggcaggcgctggaaaccgtgcaactggcggagctggcgcgtagcatgagcgacggtatttacacgccgctgggcgagcaggggaataatctctcagttgggcaaaagcaactgctggcactggcgcgcgtgctggtcgagacgccgcaaatcctgatccttgatgaggcaaccgccagcattgactccggtactgaacaggcgattcaacatgctctggcggcggtgcgtgaacataccacgctggtagtgattgctcaccgcttatcgaccattgttgatgccgacaccattctggtgcttcatcgtgggcaagccgtggagcagggcactcaccagcaactgctggcggcccagggacgctactggcagatgtatcaactgcaacttgcgggcgaagagctggcagccagcgtgcgtgaagaggaatcattgagcgcctgaatagcgcaatatttcatcgttggtgcaaaaatgtaacgcactgtgcactgtcatagtgcgttttcattttcaaacttcttaacttcctgctctctttctcgtttttcatttctggcacaccgcttgcaataccttcttcgtgtagcagaaccattaccgaattctgaccggaggggatctatgaagctggtgaccgtgataatcaaaccattcaagctggaagacgttcgtgaagcgttatcttccattggtattcagggcctgaccgtcaccgaagtgaaaggtttcgggcgtcagaaagggcatgccgagctgtaccggggggcggaatacagcgtcaatttcctgccaaaagtaaaaattgatgtggcgattgctgatgaccaactcgatgaagtgatcgatatcgtcagtaaggcggcttacaccggaaaaattggcgacggcaaaatcttcgtcgctgaattgcaacgcgtcattcgtattcgtaccggcgaagccgacgaagcggcgctgtaatctctggcacacagcaacaggaacgaaaaatgaagatagcgacgataaaaactgggcttgcttcactggcgatgcttccgggactggtaatggctgcacctgcggtggccgataaagccgacaatgcgtttatgatgatttgtactgcgctggtgctgtttatgactattccggggattgccctgttttacggtgggttgattcgcggcaaaaacgtgctgtcgatgctgacgcaggtgacggtgacatttgcactggtctgtattctctgggtggtttacggttactcgctggcgtttggtgagggcaacaacttcttcggcaacattaactggttgatgctgaaaaacatcgaactgacggcggtgatgggcagcatttatcagtatatccacgtggcgtttcagggatcgtttgcctgcattaccgtcggcttgatagttggggcgctggcggaacgaatccgcttctcagctgtgttgattttcgtggtggtatggctgacgctctcttacattccgattgcgcatatggtgtggggcggtggtttgctggcttctcacggtgcgctggatttcgcgggtggcaccgtggtgcacattaacgccgcaatcgccggtctggtgggcgcgtatctgataggaaaacgcgtgggcttcggtaaagaggcgtttaaaccgcacaacctgccgatggtcttcaccgggactgccattctctatatcggttggtttggctttaacgccgggtcagcgggcacggcgaatgaaatcgcggcactggcatttgtgaatactgtggtcgcaacggcggcggcaattcttggctggatcttcggtgaatgggcgctgcgtggtaagccttcactgctgggggcgtgttctggcgcgattgccggtctggtcggcgtgacgccagcctgcggctacattggggttggcggcgcgttgattatcggcgtggtagctggtctggcgggcttgtggggcgttaccatgctcaaacgcttgctgcgggtggatgatccctgcgatgtcttcggtgtgcacggcgtttgtggcattgtcggctgtatcatgaccgggatttttgccgccagctcgctgggcggcgtgggcttcgctgaaggtgtgacgatgggccatcagttgctggtacagctggaaagcatcgccattacgatcgtctggtccggtgttgtggcatttatcggctacaaattggcggatctgacggttggtctgcgtgtaccggaagagcaggagcgagaagggctggatgtcaacagccacggcgagaatgcctataacgcgtaacaagcactgcaaaaaacagccggacggttttcacctccggctatttttttaattgtgattacgcatcaccccttcctgaacggtcgaggcaaccagtacgccgtcttgggtataaaactcaccgcgcacaaagccacgtgcgctggacgccgaggtgctctccacgctatacagcagccattcattcaaattaaacgggcgatggaaccacatggaatggtcaatggtggcaatctgaatccccggttcgagaaaaccgatgccgtgcggctgtagagctaccggcaggaagttaagatcagaagcgtaaccgagcagatactgatgaacgcgcaggtcatccggcacgctaccatttgcgcggatccacacctgacgatgtggttctgcgacgtgacctttcagtgggttatgaaactccaccggacggacttccagcggacgatcgcagatgaatttatctttcagcactggcggcagcaggtgcgccagcgattgggcgatttgcgtttccgaagggaggccatcaggcgctggcgcggacggcattgttttttgatgttcgaaacccgcttctggtgcctggaaagaggcagtcatataaaaaatcggtttgccgttttgaatagcagcaacccggcgggcgctgaagctgttaccgtcacgcagcgtttcgacatcataaataatcggcttcttactatcgccagggcgaagaaagtagctgtgaaacgaatgtaccagccgctcttcagggacggtctcttttgcagcatacaaggcctgacccacgacctggccgccaaacacctggcgtaaacctaaatcttcactctggccgcgaaagagtccttcctcaattttttccagatttaacaatgtcagtaaattttttagcgcctgactcatataactctccagtaacaaagctgccgcagcaagccaaagtgagttgagtataacgcaaatttgctactggtccgatgggtgcaatggtctgaattacgggctaattacaggcagaaatgcgtgatgtgtgccacacttgttgacgttactattttgttaaccactcttccggcgaggaaagttagcccgctggtgcattgataataaggagaaatgaatgaaactcgtgcacatggccagtggtttagcggttgcgattgcgttggcggcttgcgcagataaaagcgcggatattcagacgccagcaccggctgcaaatacgtctatttcagcaacacaacaaccagctatccagcaaccgaatgtctccggtaccgtctggatccgtcagaaagtcgcactgccgcctgatgctgtgctgaccgtgacactttctgacgcgtcgttagccgatgcaccgtcaaaagtgctggcgcagaaagcggtgcgtactgaaggtaaacagtcaccattcagctttgttctgtcatttaacccggcagatgttcagccgaacgcgcgtattctgttgagtgcggcgattaccgtgaatgacaaactggtatttatcaccgataccgttcagccggtgatcaaccagggcggaactaaagccgacctgacattggtgccggtacagcaaaccgccgtgccggttcaggccagcggtggcgcaacgactaccgtaccttcgacttcaccaactcaggtgaatccgtcttcggcagttccagctcctacgcaatattaagcgacgttaaccctctccgcccggagagggttagtagttccagcgataacgctgcaagtcgatttgcccgcttcccgataccatcacaccttctgccagtaatgcctgtcgctgacgctgtaaatccggtccggttagcgaaattgtgccgtggcgattaaccacccggtgccagggtaaggtgctgccttcagggagacgctttaacacaccgcccacctggcgcgcggcgcggggcgatcccgccagtttcgccacatcaccgtaagtggtgacatagccttcgggaatagcggcgacgatttgccagacgcgttggggaaatgaatcttctttttccatcttttcttcctgaggtaatttttcagcataatctggaaaaacgcccgagtgaagtcgcattgcgcaagaaaccagcatctggcacgcgatgggttgcaattagccggggcagcagtgataatgcgcctgcgcgttggttctcaacgctctcaatgggggctctgttggttctcccgcaacgctactctgtttaccaggtcaggtccggaaggaagcagccaaggcagatgacgcgtgtgccgggatgtagctggcagggcccccacccatttctgcctcccaccgtttcgtcaaaaaatcccaacatggctaaactttaaccacaactgacgtcgcaagaattgtctggctgcgcagtacgcttcggaggtatgtctgatgaagtatgttgatggttttgtggttgccgttcctgccgataaaaaggatgcctatcgggaaatggccgctaaggctgcgccattgtttaaagagtttggcgcgcttcgtattgtcgaatgctgggccagcgatgtaccggatggcaaagtgaccgattttcgtatggcggtgaaagcggaagagaatgaagaggttgtctttagctggattgaatacccttcaaaagaggtccgcgacgctgctaatcaaaagatgatgtcggacccacggatgaaagagttcggcgagtccatgccgtttgacggcaagcgaatgatctatggcggattcgagtcaatcatcgacgaataggtagcgtgacgggctgtgcggcgtgccgtcagcccaaaaattcacaaatgttgctcggcccagcgtaagaaatcttctttcggtaatgccttgctgtagagccagccctgaccgtagtgcacgccatgctggcgtaaccactcttcttgtttactggtttcgattccctccgctaccattttcagtttcagtgtttttgccatttcgatgatatgcggcgtgacatttttatattccagcgcatcaacgaaagatttatcgatcttcagaatgtcgacatccagatcctgtaaataacttaaacttgaataccccgtaccaaaatcatcaagataaatttcatggcccgcctcccggtagcgagaaattatcggggcgctggttttcggatcggcaaactcgcgttcagtgagttcaagcgcgatctgtctgggattaacctgatagtgattgatcatgtcacgcagcaattgcgggattttttccgaggtgagcacgggggattcaagattgatcgaaatatgctgctgtggatgctgacgcagccagtcgcccatatcttcaaagacgcttcttataatcagtagcgtcaatggctcagaaaggcccgtttgctgtgccagcggaataaaactatctggtgacaaccaactaccgtctgtctgcggccagcgcgccagtgcctcagcaccgacaattttgccattggctaaggagacaatcggctgatagtgcacgcaaatatcacgattttcgatagcatcctgcagccgatgatgcggtgactgaatacggcgcaaaatacgcagcacaaacatcgctgccagcaggccaatcaccaacccgagcggtaaccaaataaagacttgccgatgccagcctttctgcaacattttcgttgaagcccatgtgatgatcgaaatattcatctccggtaagggcaggatatcgtaaatgattccattattttcgatatgctcaccgggtgttttttgtagcctggtaataattccctgagcaatttcatcgctgctggttatgacaacgttatgggcattgccaataatggcggcatcaatttgccatgagctatagggaatgacatcaataaaggaagcggggtcgatcatgacgacataatgtgccgttcccatggcgaccatgtaacggataatgcctaaatcgttatgcgatgttaaccagacacgataaccatctttcgaaattttacctggctcggggaaggtatcgggcggactttcatgctccagagacgaacactggggaacgttgttatcgatataagccacttcctgaatatagcgataactgtaagatacccgacgcatttccatgagatgggcttcgctacaggcagcgccttgccatctttccagctcctgcagcgcatctttcccttgtgtcgccaccttattggctcgaatagcgacgcgggaggaataggtatccagctcttcaataaacgatgtttctacctgctgatgggccagccagatgcttaagccgacaggcagcaatactgaaagaatcagtactcccgaaataaggccgaccagatgtcgtgttctcaccagcatatccttattaacacagtgtagggaaagtatatctgattgtggaaaaaggctggctggagataaggaggtagagctggtatttcatgaagtgatgggtggaaacgatcattgtcatttgaccaggcgcagagctttacgcctggtatgtaaccctaacttaagatgttgattcggcgcgagcgagggtaaaaatatcgtaaaaagacagttcacctttacggacgatcattttttgcagttgttccttatgaacatccgcgacacgcggagagttcaagatggcttcaaccagcgcggcaggtacaaagcgcgtgttgtaccattcgccgttatagcaaacgcggaaatccagcacgtcgatatcttcatagcggtagcgtgggtagacatcgaaaaagaagaaaccattaagcaggataaataatacaaccagtagccagacagagcctgacagcgtttcggactgcaacatcaccgccagggtggcaaaaaaagcaacgtacataccgataaacagccccggatgtttacggataaaactgatactaaagcggggtttgttgtcgcgtttttcgcgggtattcagagactcaatcgtttcggtcagcaggcgttgtatttcggtcatcgtttgccttcgtggtatctgcaactttccagggaacaccctattttaacgtgggaatagtagaggggaagtaacagatctaccacaattttgcataacagttgcgaaaaaccgattacaattttttaattattctggctggattaccgcccacgacaacgttgtccgggacatcttttgtgacaactgcacctgaggctaccacgacgttatcaccaatggtcacaccagggttaatgaccgcgcgtccgccaatccagacgttattaccgatggtgacgggtttccccagttcagcaccgctattacgtgctacagggtcgatgggatgtgttgccgtgtagatatgaacgcctggtgccaacatacagttatcaccgatgcgaatagggcagacatcaagcatcacgcaatcgaagttggcgaaaaaattattaccgagaaaaatgttatagccatagtcacagcgaaacgttggctcaatataagcctctgtcacctgaccgaatagatcagcgagaatttgctggcgtaatgtgtgctcttccgccagggaatgattgtatcggtgaataagctgacgagcgcgcaggcgatcgcgagataacgtctcatctgccgagcgatacaactcaccagcaatcatcttttctttttctgtgctcattactgacctccggttgctgaaaatgcggcaacacagtaagacgaaaagtcagtgaagagaacgttcccattacatctgtgtgataaagatcacatagggtatgtcttcatggcgaaaaagtataaaattcttaataaacagccggttatagctccgaaagcgaattatttattagcgaataaatttccatactgaggaagggatcttgtcgtacagtttattcatggtcaattcggcgaggcggtgatctgcggctgagtaaaataccgccagttcattatctgataattcgtatttatttttctcgataacacgctccagcgtgtcaattgtctggcaacgacgtaaacgcattaaataatcggttttcgttaaaggtttttcggacatacttctacctatggttgtaataattctaacaagataaactcgcaggattctctttcgtcgcattgacaaaacaacggaatagtcgattacctgacttccgccatttctgaagatcctgcatattaataccataactactgaacaacataaaggtgtcatccagatattcgtcgatctgctcaatgagcttattgtcttcattatacttaattttgtaattaagtgcgaaggtcgcaatatgctcaatcagttcattcaactggaggttgatcgccgaggttgggtcgtttacccagccatgattgctttcttcaaggtttgcaaggcagtcatgatacagggtttcacagagaaacttaagctgtgcgatatcatgtcttttgggtgagtattcatccataacgcgtccccttcttagcggttgaactaacggacacctttcgggatggaaaaaacttactgacctggacttgccctctcgtttgttagcttaactataagccactctttgcaggttttcatcgcattattacgaaaaattacaattaggaaggaagcgggacaggactcactttttcatactagcactaacccgcagcaggtaaaagcagtttgctcgaactattcataacatttcaggattatcgccagatgaaattggtgacactaataccaggattgctctgaatatgacgtaataaccgaggaatgaataaagaattaccgcaaataattaagaatagcctctaaatgattatggattattaaatctattagcgctacttaatataaattaactaacaatcagtattttttatgaattttatccgtggttaatactggttttcgtatgagatcctgagttggtggttcaattactccttaatgttcgtaggttatgcataaaaaaggccgcttacgcggccttagtgattacacgttgtatcaatgatgatcgacagtatggctgtgctcgatatcttcattcttgcggctaaagcggcggcgaaccaccacaaagaataccggaacgaagaagattgccagtaccgttgcggtcaccatcccgcccattacaccggtacctactgcgttctgcgcgccggaaccagcaccagtactgataaccagcggcataacgccgaggataaacgccagcgaggtcatcaggatcggacgtaaacgcatccgcaccgcatcaagcgtcgcttcaatcagacctttaccttctttatccatcaagtctttggcgaattcgacgataaggatcgcgttcttcgccgacaacccaatggttgtgagcaggcctacctggaagtaaacgtcattggtcaggccacggaaggtggcagccagcaacgcaccgataacccccagcggaacgaccagcataacggagaacggaatcgaccagctctcgtacagcgccgccagacacaggaacacgacaatcaacgaaatcgcgtacagtgaaggtgcctggttgccggagagacgttcctgataggacatccccgtccagtcatagccaacaccggtaggcagtttgctcgccagttgttccatcagctccattgcttcaccggtacttttacccggtgccgcctggcctaagatttccatggatggcaggccgttgtaacgttccagacgcggcgaaccgtactcccaacgagaagaggagaacgccgagaatggcaccatctgaccatcagcagcacgaacataccagtcgccgatatcatccggcagcatacggtatttcgcttctgacatgacataaactttcttcacacgaccgcggtcgataaagtcgttcacatagctgccgccccatgcagcgcccagagtggtgttaatgtcgttgatagaaacacccagcgcctgcgctttttcctggtcgatatcaatcttaaactgcggggtatcttccagaccgtttggacgtacgctggtcaacatatcagggtgcttcgctgcttctgcaagcaactggttacgcgcctgagtcagtttttcgtgaccaaggccagcctggtcaatcagctcaaagtcaaagccggttgcagtacccagttccacgattgcgggcaggttaaaggcgaaaaccatcgcatctttgatttgcgagaaagcgcgtgttgcacgcatggtaatcgcttcaactttgttttcttcgcccggacgatcggcccagtccttcaaggaaacgaacgcaataccggtattctgaccacgtcccgcaaagccgaagccgttaacggcgaacaccgactcaacgttgttcttttctttggtcagatagtaatgcgttacctcattgagcactttctgtgtacgttcctgcgttgcacctgctggcagctgaaccatggtcataaacacgccctggtcctcatctggcaagaaggagcttggcagacgcacgaacagataggccatgccgaccacgatgatcagatacagcaccaggtaacgccccgtactgcgcagaataccgcctacgctgtcggtgtagtggtgcgtgctcttctcgaacatgcggttaaaccagccgaagaagccttttttaccttccccgtgatcgcctttggcaatcggtttcagcatggtggcacaaagagctggagtcaggatcaacgccaccagtaccgacagcgccattgctgaaacaatggtaatagagaactgacgatagatagcaccagtagaaccgccaaagaaggccatcggtacgaataccgccgacagtaccatcgcgataccgaccagagcgccctgaatctgccccatcgacttacgggtagcttcttttggcggcaaaccttcttccgccataacacgctcaacgttttctaccacaacgatggcgtcatccaccaacaggccgatggcgagcaccatcccgaacattgttagcgtgtttatcgagaagccaaaggcggcaaggacggcaaaggtcccgagcaataccaccggtacggcaatggtcggaatcaacgtcgcgcggaagttctgcaggaacagatacataaccaggaacacgaggatgatcgcttcgaccagcgttttaaccacttcgtgaatagagattttcacgaacggcgtggtgtcgtatgggtaaacaattttcagacccgacgggaagaacggttccatcttcgccagttcagcacggattgccgcagcggtatccagcgcgtttgcaccggtcgccagcttgatccccagaccggaagccggttggccgttaaactctgcgatgatgtcgtagttctcaccacccagctcaatcttcgcgacgtcacgcagcagcacgcgggaaccatcctgattcactttcagcaggattttgccgaactcttcagtagaggtcagacgcgtctgagcaataatagaggcgttaagctgttggcctttcaccggcggcgtaccaccgagctgacccgccgcaacctgggcgttctgcgctttgatggcggtaatgacatcaaccggcgttagctggaatttgttcagctcattcgggttcatccagatacgcatcgcgtactgtgaaccgaacaactgaacatcacccacgcccgacgtacggctgatggcatctttcatattcgccgccacgtagtcggagatatcctcctgcgtcatggtgccatcggtgttgataacgccgacaaccatcaggaagctgctggatgatttctcaacgctcaccccttgctgctgaacttcttgcggcagcaacggcatcgccagctgcagtttgttctgcacctgaacctgcgcgatatccgcatcagtaccagactcaaaggtcagggtgatctgcacggtacccgtggagtcactgttagaggacatgtacatcaggttatcgataccgttcatattctgttcgataacctgtgtcaccgtgtcctgcactgttttcgcatcagcgccggggtaggaggcggagatcgttactgccggcggtgcaatcgtaggatattgcgccaccggcagtttgaggatcgccagcccccctgccaacatgatgataatggcgatcacccacgcaaaaatcgggcgatcgataaagaaattaggcatgtcttaacggctcctgtttaagttaagacttggactgttcaggctgagcaccgcttgcggcttgctggttattatcagcggtaacttcttgtgcttttacctggacaccaggacgcactttctgcagcccacttattactacgcgatcgcctgctttcagaccttctgtcaccagccacttatcgccaatagcctggcttgcaacgatcggacgggtttccactttgtcatccgcgccaactaccagtacggtggcatcgccacgcggcgtacgggttacgccctgttgcgggactaaaatagcgtttggattaagcccttcttccagacgtgcgcgcacgaacatacccggcagcagagtgtgatccgggttcgggaagatagcgcgtagggtgatagacccagtggtctgatcaacggtaacgtcagagaattccagcgtaccgtcctgcgggaacttaatgccgtcactggtgatcagtgacactttggctttgccgttctcttgtttcagcgtgccattcgccagttcctgtttcaggcgcaggaagtcgttgctggactgggtcacatcaacgtagatcggatcaagttgctgcacggttgccagcgcagtcgcctgaccgttctgtaccaatgcgccttccgtcacgttcgacttaccaatgcgaccgctaatcggagaggtgactttggtgtaagccagattgatccgcgcagtttcaacggcagctttcgccgcagttaccgcagcattcgcctgttgcgcatcagccagagcctgatcgtactcttgcttactgatgtactgagtaccgagcagtttctgataacgattcaccgtcaattgcgcgatattggctgcagcctgggctttcgccagatcacctttcgcactgtcgtatgtcgcctgataggtcgcaggatcaatctgatagagagagacacctgcttcgatgtcgctaccttctttgaaattacgcttcaggataatcccgctaacttgaggacgaacttctgcgatccggtaggcactggtgcgacccggaagctcggttgtgatctgcagaggttcagttttgactgttactacgccaacggcgggcatctgctggccaccttgttgggcctgtttgtcgtcacatcctgttagggctaagctgcctgagagcatcagaacgaccgccagaggcgtaaaccctctgtttttgttcatatgtaaacctcgagtgtccgatttcaaattggtcaatggtcaaaagttaataaacccattgctgcgtttatattatcgtcgtgctatggtacatacattcacaaatgtatgtaaatctaacgcctgtaaattcacgaacatatggcacgaaaaaccaaacaagaagcgcaagaaacgcgccaacacatcctcgatgtggctctacgtcttttctcacagcagggggtatcatccacctcgctgggcgagattgcaaaagcagctggcgttacgcgcggtgcaatctactggcattttaaagacaagtcggatttgttcagtgagatctgggaactgtcagaatccaatattggtgaactagagcttgagtatcaggcaaaattccctggcgatccactctcagtattaagagagatattaattcatgttcttgaatccacggtgacagaagaacggcgtcgattattgatggagattatattccacaaatgcgaatttgtcggagaaatggctgttgtgcaacaggcacaacgtaatctctgtctggaaagttatgaccgtatagaacaaacgttaaaacattgtattgaagcgaaaatgttgcctgcggatttaatgacgcgtcgcgcagcaattattatgcgcggctatatttccggcctgatggaaaactggctctttgccccgcaatcttttgatcttaaaaaagaagcccgcgattacgttgccatcttactggagatgtatctcctgtgccccacgcttcgtaatcctgccactaacgaataaccctgaatctgactccaggatttttcctggacattttcgtcgttgctattctggttcactgcgtcgtgatattcttgcggtttgactttttcaggtcgttcttcaggttcagaaaccttcattcatcatgactatgttccagtattacaaacgatcacggcattttgttttttcagcatttattgcttttgtttttgtcttgttatgccagaacacggcgtttgcgcgggcgtcatcgaatggtgatctgccgacaaaagcggacctgcaggcgcaacttgactcactaaataaacaaaaagatctttctgctcaggacaaactggtgcagcaggatctgacagatacattagccaccctcgataaaatcgatcgcataaaagaagagacagttcagctacggcaaaaagtcgctgaagcgccggaaaaaatgcgccaggcgaccgcggcgttaacagcacttagcgatgtcgataacgacgaagaaacgcgcaaaattctgagcacgctgtcgttgcgccagctggaaactcgcgttgcccaggcgctggacgatttgcaaaacgcacaaaacgatctggcgtcttataacagccagctggtttcgttacagacgcagcccgaacgcgtgcaaaatgcgatgtataacgcttcgcagcagctgcaacaaattcgcagtcgtctggatgggactgatgtcggcgagacagccttacgtcccagccagaaagtgttaatgcaggcccagcaggcgttgctgaatgcggagattgaccagcagcgtaaaagcctggaagggaacaccgtcttgcaggataccttgcaaaagcaacgtgattacgtgacggcgaacagcgctcgtctggagcaccagttacaactgttgcaagaagcggtaaacagcaagcgcctgactttaaccgaaaaaacggcgcaggaagccgtctccccggatgaagccgcgcgtattcaggctaatccgctggtgaagcaggaactggaaattaaccagcagttaagtcagcgtctgattaccgcgactgaaaacggtaatcagttgatgcagcaaaacattaaagtcaaaaactggctggagcgggcgctgcaatcggaacgcaatattaaagagcagattgccgtcctgaagggcagcctgctgttgtctcgtatcctttaccagcaacaacaaacgctgccctcggcggatgaactggaaaacatgaccaaccgcatcgcggatttgcgtctcgaacagtttgaagttaaccagcagcgtgatgcactcttccagagcgatgcgttcgtcaacaaactggaagaaggtcacaccaacgaagtcaacagcgaagttcacgatgcgttattgcaagtggttgatatgcgtcgcgaattgctggatcaactcaacaaacagttgggtaaccagctgatgatggccattaacctgcaaatcaaccagcagcagttaatgagtgtgtcgaaaaacctgaaatccatcctgactcagcaaatcttttgggtgaacagtaaccgtccaatggactgggactggatcaaagcgttcccgcaaagcctgaaagatgaatttaagtcgatgaaaatcacggtgaactggcaaaaagcctggcccgccgtttttatcgctttcctcgctggtttgccgctgctgttgattgccgggctgatccactggcgtctgggctggctgaaagcgtatcaacaaaaactggcttccgctgtgggttccctgcgtaacgacagccagctcaacacaccaaaagcgatccttatcgacctgatccgtgcgctgccggtgtgcctgattattctcgcggttggcctgattctgttgaccatgcagctcaacatcagcgaactgctatggtcgttcagcaaaaaactggcgatattctggctggtgtttggcctgtgctggaaggtactggagaaaaacggcgttgccgtacgtcacttcggcatgccggaacagcagaccagccactggcgtcggcaaattgtccgcatcagtctcgcattgctgcctatccatttctggtctgtggtggcagaactttccccgctgcatctgatggatgatgtgctggggcaagcgatgattttcttcaacctgctgctgattgccttcctggtatggccgatgtgccgcgaaagctggcgtgataaagagtcgcacaccatgcgactggtcaccattaccgtgctgtcgataatcccgattgcgctgatggtgctgactgctacaggctacttctacactacgctgcgtctggcaggacgctggattgaaaccgtttatctggtgatcatctggaacctgctgtaccagacggtactgcgtggcttaagcgtagcggcgcggcgtatcgcctggcgtcgtgcgctggcgcgtcggcagaatctggtgaaagagggcgcagaaggtgctgaaccgccggaagaacccaccattgcactggagcaagttaaccagcagacgctgcgtattaccatgttgctgatgtttgcgctgttcggtgtcatgttctgggcaatttggtccgatttgatcaccgtgttcagctatctcgacagcatcacgctctggcattacaacggcactgaagctggcgctgcggtggtgaaaaacgtcaccatgggcagtctgttgtttgcgattatcgcctcaatggtggcctgggcgttgattcgcaacctgcctggtttactggaagtgctggtgctctcgcgactgaatatgcgccagggcgcgtcgtatgccattactaccatccttaactacatcattattgctgttggtgcgatgacggtgttcggatcgctgggcgtctcttgggataaactccagtggctggccgcagcattatccgtaggtcttggttttggtttacaagaaattttcggtaacttcgtctccggtttgatcattctattcgaacgtccggtgcgtattggcgatacggtaaccattggtagcttctcggggacggtaagtaagatccgtattcgtgcgacaacgattaccgatttcgatcgcaaagaagtgatcatcccgaacaaagcgtttgttaccgagcgtctgatcaactggtcgttgactgacactactacgcgtctggtgatccgtctcggcgtggcctatggctccgatctggaaaaagtgcgtaaagtgttactgaaggcggcgactgagcacccaagggtgatgcacgaaccaatgccggaagtcttctttacggcatttggtgccagcacgttggatcatgagctgcgtctgtatgtgcgtgaactgcgtgaccgtagtcgtactgtcgatgagctgaaccgtactatcgatcagctgtgccgtgaaaacgacatcaacattgcctttaaccagcttgaagtgcatctgcacaacgagaagggcgatgaggtgacggaagtaaaacgcgactacaaaggcgatgacccgacgccagcggtagggtaaaaacgaaagggggcaacatttagttgccccgagattgctaacaaagtgcgcgttgttcatgccggatgcggcgtgaccgccttatccggcctacgaaaccgcaagaattcaatatattgcaggagcggtgtaggcctgataagcgtagcgcatcaggcagttttgcgtttgcccgcaaccttaggggacatttagcgaccccatttatttctcacttttccgcctcatcatcgcgcgttaatttcttttcataatcacgctttacaatatccagcgcgcgcagcacggtactggcagggatctgattttcctccagcagcacaatcaaatcgacagccagtttgacatcgtcaggggcattttccagtgacatattctctccattgctagcgggttaaacgcgctaacctgttttcgattttttccagcgcatggcggcagcgtgccaggcgcgcttcataggcttccacttcacgatgcagcgtttgctgttccacgagatcggtcacccgcgccagacgggctctgcgttcggcaaccatctcacgtagccgccgctcaaaatcctgatgctgaatacgtttacgctgccagcgggcaattttcggtggtgcactgtcccactcgcgcaatgaccaggcggaggcttcacgcgcgatggcttccagttgtgccgccagatgttccgccagccaggccacttgcggcagctgttgctgctcaactgcatgacgaagcgcagccagattatcgcccgcctcgtcgagacaagcctgtagtgttgtcgcacgagtctgaaaaagatgcctgtcgaaacgagcacttagcgtggcgaactgtgacaccggggcacaacgctgacgcagcgtagcgagctgtccttccagtttttccagcagcagggcggttttcacgataagacctcaatgaaaatgataattgttatgctaaagtagccactctgtaagctgacaacactcaatatgcaacgaatcattttaatcatcattggctggctggcggtagtgctgggtacgctgggcgtggtattaccggtattaccgacgacgccgtttatcctgctggcggcctggtgctttgcccgttcttccccgcgctttcacgcctggttgctgtaccgctcatggtttggcagctatctacgtttctggcagaaacatcatgcgatgccgcgcggcgtcaaaccgcgggcgattttgcttattttgctcacgtttgccatttctctgtggttcgtccagatgccatgggtgcgcatcatgttgctggtaattctcgcctgtttgcttttctatatgtggcgaattccggtgattgatgaaaagcaagaaaagcactgaagcacaacaatcgcagttgcaattattgcgtacagccagtacattctggcgttttcgagcacaggcgcaggcggtcaaaggttaaacaactgttacttttgatacgtttaaaacgcgccgtgagtaccaccgtaacaagcaggcatacacttatgaccgcgactgcacagcagcttgagtatctcaaaaatagcatcaaaagcattcaggactacccaaaacccggcattcttttccgcgatgtcaccagcttactggaagacccgaaagcttacgctctcagcatcgacttgctggttgagcgttacaaaaatgcgggcattaccaaagttgtcggcaccgaagcgcgtggcttcttgtttggcgctccggtagctctgggtctgggcgttggctttgtaccggtccgtaaaccgggcaaactgccgcgtgaaaccatcagtgaaacttacgacctggaatacggcaccgatcagctggagatccacgttgatgccatcaaaccgggcgacaaagttctggtggtggacgacctgctggcaaccggcggcactatcgaagcgaccgttaaactgatccgtcgtctgggtggtgaagtggctgacgctgcgttcattatcaacctgttcgatctcggcggcgaacagcgtctcgaaaaacagggcattaccagctacagccttgtcccgttcccgggccattaattatcgccagtcttgtgctgcccacgctacggacagcacaagatgtgcattcagcctcgccgttctgacggggctgtgttagcattaccccttcgtgaatccaccttccagcgtttcagagcctgccaatgagttatcaggtcttagcccgaaaatggcgcccacaaacctttgctgacgtcgtcggccaggaacatgtgctgaccgcactggcgaacggcttgtcgttagggcgtattcatcatgcttatcttttttccggcacccgtggcgtcggaaaaacctctatcgcccgactgctggcgaaggggctaaactgcgaaaccggcattaccgcgacgccgtgcggcgtgtgcgataactgtcgtgaaatcgagcaggggcgctttgtcgatctgattgaaatcgacgccgcctcgcgcaccaaagttgaagatacccgcgacctgctggataacgtccagtacgctccggcgcgtggtcgtttcaaagtttatctgatcgacgaagtgcatatgctgtcgcgccacagctttaacgcactgttaaaaacccttgaagagccgccggagcacgttaagtttctgctggcgacgaccgatccacagaaattgccggtgacgattttgtcacgctgtctgcaatttcatctcaaggcgctggatgtcgagcaaattcgccatcagcttgagcacatcctcaacgaagaacatatcgctcacgagccgcgggcgctgcaattgctggcacgcgccgctgaaggcagcctgcgagatgccttaagtctgaccgaccaggcgattgccagcggtgacggccaggtttcaacccaggcggtcagtgcgatgctgggtacgcttgacgacgatcaggcgctgtcgctggttgaagcgatggtcgaggccaacggcgagcgcgtaatggcgctgattaatgaagccgctgcccgtggtatcgagtgggaagcgttgctggtggaaatgctcggcctgttgcatcgtattgcgatggtacaactttcgcctgctgcacttggcaacgacatggccgccatcgagctgcggatgcgtgaactggcgcgcaccataccgccgacggatattcagctttactatcagacgctgttgattggtcgcaaagaattaccgtatgcgccggaccgtcgcatgggcgttgagatgacgctgctgcgcgcgctggcattccatccgcgtatgccgctgcctgagccagaagtgccacgacagtcctttgcacccgtcgcgccaacggcagtaatgacgccaacccaggtgccgccgcaaccgcaatcagcgccgcagcaggcaccgactgtaccgctcccggaaaccaccagccaggtgctggcggcgcgccagcagttgcagcgcgtgcagggagcaaccaaagcaaaaaagagtgaaccggcagccgctacccgcgcgcggccggtgaataacgctgcgctggaaagactggcttcggtcaccgatcgcgttcaggcgcgtccggtgccatcggcgctggaaaaagcgccagccaaaaaagaagcgtatcgctggaaggcgaccactccggtgatgcagcaaaaagaagtggtcgccacgccgaaggcgctgaaaaaagcgctggaacatgaaaaaacgccggaactggcggcgaagctagcggcagaagccattgagcgcgacccgtgggcggcacaggtgagccaactttcgctaccaaaactggtcgaacaggtggcgttaaatgcctggaaagaggagagcgacaacgcagtatgtctgcatttgcgctcctctcagcggcatttgaacaaccgcggtgcacagcaaaaactggctgaagcgttgagcatgttaaaaggttcaacggttgaactgactatcgttgaagatgataatcccgcggtgcgtacgccgctggagtggcgtcaggcgatatacgaagaaaaacttgcgcaggcgcgcgagtccattattgcggataataatattcagaccctgcgtcggttcttcgatgcggagctggatgaagaaagtatccgccccatttgatcgtaagcacagcttacgttcgtcatccttaacgtgattgagagagaaacctatgtttggtaaaggcggtctgggtaacctgatgaagcaagcccagcagatgcaagaaaaaatgcagaaaatgcaggaagagatcgcgcagctggaagtcaccggcgaatctggcgcaggtctggtaaaagtgaccatcaacggtgcacacaactgccgtcgcgtagagatcgacccgagcctgctggaagacgacaaagagatgctggaagacctggtggctgcagcattcaacgacgcagcacgtcgtattgaagaaacgcagaaagaaaaaatggcctctgtatcctccggaatgcagctgccgcctggctttaagatgccgttctgatgcaaaccagcccgctgttaacacagcttatggaagcactgcgctgtctgccgggcgttggcccgaagtcggcgcagcgtatggcgttcacgctgcttcagcgcgatcgtagcggcgggatgcgtctggcgcaggcgctcacccgggcgatgtcggaaatcggccactgcgccgattgccgcactttcaccgaacaggaagtctgtaacatctgttcgaatccgcgtcgtcaggaaaacggtcaaatctgcgtggtggagagtccggcggacatctacgccattgagcagacggggcagttttcaggtcgttattttgtgttgatggggcatctgtcaccgctggacggcatcggtccggatgatatcgggcttgatcgtctggaacagcgtctggcagaggaaaaaatcactgaagtgatcctcgccaccaaccccacggttgaaggtgaagctaccgctaactacattgccgagctttgcgcgcaatatgacgtggaagccagccgaatcgctcatggcgttccggttggcggcgagctggaaatggtcgacggcaccacgttgtcacactcccttgccgggcgtcataagattcgtttttaagcaaacgagagcaggatcacctgctctcgcttgaaattattctcccttgtccccatctctcccacatcctgtttttaaccttaaaatggcattattgaggtagacctacatgaaaggacaagaaactcgtggttttcagtcagaagtgaaacagcttctgcacctgatgatccattctctctattccaataaagaaatcttcctgcgtgagcttatctctaacgcctccgatgcggcggacaagctgcgtttccgtgcgctctctaacccggacctgtacgaaggtgatggcgaactacgcgttcgtgtctctttcgataaagacaagcgtacgctgaccatctccgataacggcgtggggatgacccgcgacgaagtgattgaccatctggggactatcgctaaatccggtaccaaatcattcctcgaatccctgggttctgaccaggcgaaagacagccagctgatcggtcagtttggtgttggtttctactctgcgtttatcgtggccgacaaagtgaccgtgcgtactcgcgcggcaggcgaaaaaccagaaaatggcgtcttctgggaatcggctggcgaaggtgaatacaccgttgccgacatcaccaaagaagatcgtggtactgaaatcaccctgcatctgcgtgaaggcgaagacgagttcctcgatgactggcgcgtgcgttccatcatcagcaaatactccgaccatatcgcgctgccggtagagatcgaaaaacgcgaagagaaagacggcgaaaccgttatctcctgggagaaaatcaacaaagcgcaggcgctgtggactcgtaacaagtcggaaatcaccgatgaagagtacaaagagttctacaaacacatcgcccacgactttaatgatccgctgacctggagccacaaccgtgttgaaggtaagcaggagtacaccagcctgctgtacatcccgtcccaggctccgtgggatatgtggaaccgcgatcataaacacggcctgaaactgtatgttcagcgtgtgttcatcatggacgacgcagaacagttcatgccgaactatctgcgcttcgtgcgtggtctgattgactccagcgatctgccgctgaacgtttcccgtgaaatcctccaggacagcacggtaacgcgtaacctgcgcaatgcgctgaccaagcgtgtgctgcaaatgctggaaaaactggcgaaagacgacgcggaaaaataccagaccttctggcaacagtttggcctggtactgaaagaaggtccggcggaagatttcgctaaccaggaagcgatcgccaaactgctgcgttttgcttctacccataccgattcttctgcgcagaccgtatctctggaagactacgtttcccgcatgaaagaagggcaggagaaaatctactacatcaccgcagacagctatgcggcagcgaagagcagcccgcacctggaactgctgcgtaagaaaggcatcgaagttctgctgctttccgaccgcatcgatgagtggatgatgaactatctgactgagttcgacggtaaaccgttccagtcggtgtctaaagttgacgagtcgcttgaaaaactggctgacgaagttgatgagagcgcgaaagaagcggagaaagcactgactccgttcatcgaccgtgtgaaagccctgctcggcgagcgcgtgaaagatgtccgtctgactcaccgtctgaccgatacgccagcgatcgtttcgaccgacgcggacgaaatgagcactcagatggcgaaactgttcgctgcggcgggccagaaagtgccagaagtgaaatacatcttcgaactgaacccggatcacgtactggtgaaacgtgcggcagatactgaagatgaagcgaagttcagcgagtgggtagaactgctgctggatcaggcgctgctggcagaacgcggcacgctggaagatccgaacctgtttattcgtcgtatgaaccagctgctggtttcctgatgtaatgccggatgaccttcgtgtcatccggcatttttcttttcatcatctgcactttccgcaaattatctcgccattaaccgtttcagccccaggtgcctttcttgaggcaatcgcctgttggtggtatcgtttatcgctttttcaaaaaattcgacacattttaaggggattttcgcaatgcgtatcattctgcttggcgctccgggcgcggggaaagggactcaggctcagttcatcatggagaaatatggtattccgcaaatctccactggcgatatgctgcgtgctgcggtcaaatctggctccgagctgggtaaacaagcaaaagacattatggatgctggcaaactggtcaccgacgaactggtgatcgcgctggttaaagagcgcattgctcaggaagactgccgtaatggtttcctgttggacggcttcccgcgtaccattccgcaggcagacgcgatgaaagaagcgggcatcaatgttgattacgttctggaattcgacgtaccggacgaactgatcgttgaccgtatcgtcggtcgccgcgttcatgcgccgtctggtcgtgtttatcacgttaaattcaatccgccgaaagtagaaggcaaagacgacgttaccggtgaagaactgactacccgtaaagatgatcaggaagagaccgtacgtaaacgtctggttgaataccatcagatgacagcaccgctgatcggctactactccaaagaagcagaagcgggtaataccaaatacgcgaaagttgacggcaccaagccggttgctgaagttcgcgctgatctggaaaaaatcctcggctaattcgaaagcgcgcacggacagtcccctcgccccctcggggagagggttagggtgaggggaacaggcccgcacaagcaaacttatcagcaatctcaggccggatattcattcggccttttacaaaaacctcaatctgcgctattcctttttctgatttgacctctcacagcaattagttcttcttcctcacttttccgctacaattatcaacaagttgaatcgataagaggcggtaatgcgtcagactaaaaccggtatcctgctggcaaacctgggtacgcccgatgcccccacacctgaagcggtaaaacgctatctgaaacaatttttaagcgacagacgcgtggttgatacctcacggttgttatggtggccattgctgcgcggcgtgattttgccgctgcgctcgccgcgtgtggcgaagctgtatgcctctgtctggatggaaggtggctcgccgctgatggtttacagccgccagcaacagcaggcgctggcacaacgtttaccggagatgcccgtagcgctgggaatgagctacggctcgccatcactggaaagcgccgtagatgaactcctggcagagcatgtagatcatattgtggtgctgccgctttatccgcaattctcctgttctacggtcggtgcggtatgggatgaactggcacgcattctggcgcgcaaacgtagcattccggggatatcgtttatacgtgattacgccgataaccacgattacattaatgcactggcgaacagcgtacgcgcttcttttgccaaacatggcgaaccggatctgctactgctctcttatcatggcattccccagcgttatgcagatgaaggcgatgattacccgcaacgttgccgcacaacgactcgtgaactggcttccgcattggggatggcaccggaaaaagtgatgatgacctttcagtcgcgctttggtcgggaaccctggctgatgccttataccgacgaaacgctgaaaatgctcggagaaaaaggcgtaggtcatattcaggtgatgtgcccgggctttgctgcggattgtctggagacgctggaagagattgccgagcaaaaccgtgaggtcttcctcggtgccggcgggaaaaaatatgaatatattccggcgcttaatgccacgccggaacatatcgaaatgatggctaatcttgttgccgcgtatcgctaaagctgagcggtaaagaactgagcgccgtcgcgaagagcctcgtcggcggttttcatcatccgtgaataatgcaaaaaggcgtgcagcgtgcctgggtagagtttgaactcacagggctgctgatgcgccgctaacgtctggtaaagcagacggctgtcatccagcagcggatcgaactccgccccggcaataaaacagggcggaacttcgcgagtgagatcattattaaacagacagtaatacggcgactcgcggtccgcgtcgttgcttaaatatgcctcttcgtacatctgcaaatcctgttgcgttaagccatcccagacaccgcccaacagacgacgagtcacggaatcccgtaatccgtaaagcccataccacagcaaaacgcccgcaactttaccgcaatcgatctgtttatcacgcaaccacaacgcactggcgagcgccagcatggcacctgcggaatcaccggcaaagccaatgcgggacatattgatttgataatcctccgcctgctggtggaaataacaacaagcagccacaatttcctctatcgcttgcggaaaacgcgcttcaggtgaaagggtgtaatcaataccaatcaccgtacattggctgtagcttgccagcaggcgcatgatgcgatcgtgggtatcgagattgccgagaataaaaccgcctccatgcaaataaaatagcgtcgctgggctatctggctgcggacaaaagagacgtgtttccacctgcccatattttgttggaaccatgtaagctctggttgccatttctggagcgcccgcattccagaatcggcgctcaagcgtgtaatactgtcgttgctcagcaatcgttcccgttgcgggccagggcggtaaatccggctgaagagtattcacaacggtcttcatttcagcagaaataaggtccagaacaggtagtttgttttccggcttcatacaaaaactcctttcaaattacgtcattgtaaggaaccactgccatgaaaatgcgatcccgcctgctgatattgaaactggctgcgtctcgcgcgctcccgtcagattgtgttaacattcgccgctcagttaaccacccgtaaaaacaaccatgaaatttcccggtaaacgtaaatccaaacattacttccccgtaaacgcacgcgatccgctgcttcagcaattccagccagaaaacgaaaccagcgctgcctgggtagtgggtatcgatcaaacgctggtcgatattgaagcgaaagtggatgatgaatttattgagcgttatggattaagcgccgggcattcactggtgattgaggatgatgtagccgaagcgctttatcaggaactaaaacagaaaaacctgattacccatcagtttgcgggtggcaccattggtaacaccatgcacaactactcggtgctcgcggacgaccgttcggtgctgctgggcgtcatgtgcagcaatattgaaattggcagttatgcctatcgttacctgtgtaacacttccagccgtaccgatcttaactatctacaaggcgtggatggcccgattggtcgttgctttacgctgattggcgagtccggggaacgtacctttgctatcagtccaggccacatgaaccagctgcgggctgaaagcattccggaagatgtgattgccggagcctcggcactggttctcacctcatatctggtgcgttgcaagccgggtgaacccatgccggaagcaaccatgaaagccattgagtacgcgaagaaatataacgtaccggtggtgctgacgctgggcaccaagtttgtcattgccgagaatccgcagtggtggcagcaattcctcaaagatcacgtctctatccttgcgatgaacgaagatgaagccgaagcgttgaccggagaaagcgatccgttgttggcatctgacaaggcgctggactgggtagatctggtgctgtgcaccgccgggccaatcggcttgtatatggcgggctttaccgaagacgaagcgaaacgtaaaacccagcatccgctgctgccgggcgctatagcggaattcaaccagtatgagtttagccgcgccatgcgccacaaggattgccagaatccgctgcgtgtatattcgcacattgcgccgtacatgggcgggccggaaaaaatcatgaacactaatggagcgggggatggcgcattggcagcgttgctgcatgacattaccgccaacagctaccatcgtagcaacgtaccaaactccagcaaacataaattcacctggttaacttattcatcgttagcgcaggtgtgtaaatatgctaaccgtgtgagctatcaggtactgaaccagcattcacctcgtttaacgcgcggcttgccggagcgtgaagacagcctggaagagtcttactgggatcgttaagttatcgtcggttcgtaggccagataaggcgttcacgccgcatctggcatttggctctcgatgcctgatgcgacgctggcgcgtcttatcatgcctacatatttttcatattttacatccggcaaccaccgtttaccccgtcaccacctcacccgccggtggcgtttccagcagttccagcatggtacgggcgatttcacgctcgcccatcactacctgattcgcaccacgttcggtgatatacgccacttcatcgtcataatgggcgcgggcaataatctcaatatccggatttttcgcgcgggcagatgccacaatctcacccgcttcataaccgttgggaatcgtcaggatcagccattttgcacattccagatgcgccagttgcataatttcttcgttcgccgcattgcccaatactgcgcggaccccgcgctctcgcagctcatcaacacgggttcgtgacgtctcaatcaccaccagcggaatatcagaggcgagcaatttctcccccagcaggctgcctacacgaccgtaacccaccagtagcgcatggttgcaaatatccactgggatctgcttctcttcttcgattgcctcttccagcgtctgctcttccagcgtttcggtcttcgccagatatttctccagtagtgcgaacagtaccgggttgagcataatcgacaggatcgcccctgccagtaccaggttttgtccggcctgcggcagtaaattcaatgccattcccagtcccgccaggataaacgcgaactcaccaatctgcgccaggctggcggcgatggttaatgccgtacgttgggagtgaccaaacagtcgcaccaggaaaaatgcggctaacgacttaccaaacagaataatcgccagcgtcgccagcactgccagcggttgctgaatcagaattaacggatcaaacaacatcccgacggagacaaaaaacagcaccgcaaacgcgtcgcgcaatggcagcgtatcgtgggcggcacggtgactcagttcagactcgttcagtaccatcccggcaaagaacgcaccgagtgcaaaggagacatcaaacagctctaccgcaccaaaggcaacccctaacgccagcgccagcaccgacagggtaaacagctcgcgagaaccggttgccgcgctgcgtgccataatccacggcaccagacggcgacctaccagcatcataatggcgataaatgcgatcactttgccgatggtgatccccatatcgactgcaagagtggcaaagcccacatcgccctgttccatcattcctgccactgcgggcagcaacaccagcgtcagaaccattaccaggtcttccacaatcaaccaaccgatggcgatttgcccacgctgactgtcaattaattgccgttcttcaagtgcgcgcagtaacaccacggtactggcggtggaaagacataaaccgaacacgataccggtcattaacgaccagcccagcacggcagagagcgccatacccagcagcgtcgccacggctatctgggcgatcgcaccgggaatggcgatggcctttaccgccatcaaatccttcagcgaaaagtgcaaaccgacgccaaacatcaacagaatgacgcccagttcagccagttccggggcaagcttggtatcggcaacaaagcccggagtgaatggtcctgccagcacacccgctaacagatatcccaccagaggagaaatacgtagtttattggccagcatgccgaggataaaggcgagcacaaggccgccaacaatggtggtgataagcggggtggcgtgatgcattccgtctccttttcctggtggttattgtccatttttggccgggaaaaccaaaattacaggtaatagtttatgacaatttcattgatgatgttcatgaataattattgaattttgcagaaaaatggaattagctgcaaaaaaagcacggatcggaaaacagaaggcggtttaacagaggaaaggcttatggcgactgtaaaacgatgcagccaaagtttgcctttggctgcaatgaaatcagtctttatgccggttatcaggcaggaatatggtcaacatccccaatagtggcaggaaagcacagattttatagactaactcgatgctggtgtgatcggcgataagccccagaactgccgctcccagacctcccatgccaaaagcaaaaccgaaaaagagtccagaaaccataccgatacgtcctggaagcagctcctgagcgtagaccagaatggcagagaatgccgaagcgaggataaatccaataatcaccgttaaaacccccgtccagtgcaggctggcgtagggtaaaatcagcgtaaacggcgcaacgccgaggatagagccccaaatcacatatttccgcccaattttatcccctacaggcccgccgatcaccgtacctgccgcaacggcaaacaggaaggcaaacagatgaagctgagcattctggatagataatccgaatttttgcatcagataaaaggtgtaatagctgctgatgctcgccatatagaaatatttcgagaaaatgaggattaacagaatgctgaccgccagtacaactttattgcgcggcagtggattgataatcgtcgctttgggttttcctttattcattcggtgctgtgccgagtaccaacggctgatttgcgccaacaccacgatcgccagcagtgccgcaagcacaaaccaggcaacgttgcctttgccataaggcgcgataatcaccgccgccagcaagggtcccagggaactgccaaagttgccgccgacctgaaagatagattgcgccaggccatgccgcccgccggaagccatacgggccacgcgagaagattccggatgaaagaccgatgaaccggtaccgaccagcgccgccgccagcagaactgcgccaaaactgcccgccagcgcaagcagcaccagaccgcttaaggtaaagcacatgccaattggcaacgaccatggcatcggatatttatcggtccagtagccgaccactggttgcagtagcgaagaggcgagctggaaggtgagggttatcatgccaatctgcataaatgtcagagaaaattctgactgaagcagcggataaatcgccagaatcagcgattggatcatgtcgttcagcagatgtgagaggctgatagcacctaaaataccaaacgatgttcgggccttggtcgttgacgcagccgcgcccgccacaggctggggttgttcactcattgccataggaaagtcactttttcagggttgcgatgtaaagaatgatcttatttgtgattattaccagactaacatacctgtatgcgtcgtctgaaggaagtctcaacgccgaatacagaatttctaatctggatgcagatttatcttcaccggacgcagacttgtctatgatgtcgcgtcatactatttttcaacacgttgaaatcaggtcagggagagaagtatgaaattattgcagcggggcgtggcgttagcgctgttaaccacatttacactggcgagtgaaactgctctggcgtatgagcaggataaaacctacaaaattacagttctgcataccaatgatcatcatgggcatttttggcgcaatgaatatggcgaatatggtctggcggcgcaaaaaacgctggtggatggtatccgcaaagaggttgcggctgaaggcggtagcgtgctgctactttccggtggcgacattaacactggcgtgcccgagtctgacttacaggatgccgaacctgattttcgcggtatgaatctggtgggctatgacgcgatggcgatcggtaatcatgaatttgataatccgctcaccgtattacgccagcaggaaaagtgggccaagttcccgttgctttccgcgaatatctaccagaaaagtactggcgagcgcctgtttaaaccgtgggcgctgtttaagcgtcaggatctgaaaattgccgttattgggctgacaaccgatgacacagcaaaaattggtaacccggaatacttcactgatatcgaatttcgtaagcccgccgatgaagcgaagctggtgattcaggagctgcaacagacagaaaagccagacattattatcgcggcgacccatatggggcattacgataatggtgagcacggctctaacgcaccgggcgatgtggagatggcacgcgcgctgcctgccggatcgctggcgatgatcgtcggtggtcactcgcaagatccggtctgcatggcggcagaaaacaaaaaacaggtcgattacgtgccgggtacgccatgcaaaccagatcaacaaaacggcatctggattgtgcaggcgcatgagtggggcaaatacgtgggacgggctgattttgagtttcgtaatggcgaaatgaaaatggttaactaccagctgattccggtgaacctgaagaagaaagtgacctgggaagacgggaaaagcgagcgcgtgctttacactcctgaaatcgctgaaaaccagcaaatgatctcgctgttatcaccgttccagaacaaaggcaaagcgcagctggaagtgaaaataggcgaaaccaatggtcgtctggaaggcgatcgtgacaaagtgcgttttgtacagaccaatatggggcggttgattctggcagcccaaatggatcgcactggtgccgactttgcggtgatgagcggaggcggaattcgtgattctatcgaagcaggcgatatcagctataaaaacgtgctgaaagtgcagccattcggcaatgtggtggtgtatgccgacatgaccggtaaagaggtgattgattacctgaccgccgtcgcgcagatgaagccagattcaggtgcctacccgcaatttgccaacgttagctttgtggcgaaagacggcaaactgaacgaccttaaaatcaaaggcgaaccggtcgatccggcgaaaacttaccgtatggcgacattaaacttcaatgccaccggcggtgatggatatccgcgccttgataacaaaccgggctatgtgaataccggctttattgatgccgaagtgctgaaagcgtatatccagaaaagctcgccgctggatgtgagtgtttatgaaccgaaaggtgaggtgagctggcagtaatccgaaagtgccggatgtttgcatccggcacaatgcttaatcgcggcgggcgatatcagcaaatttggcatcgaggatctttgccagatcgcctgccgccagttcgatatccagtccgcgcttgccgccggaaacataaatagtggcaaattcttgtgcgggggcgtcgataatcgttggcagacgttttttctgccccagtgggctaatccccccaaccaggtatcccgtcgaacgctgcgcgaccatcggatcggccatctcaactttcttggcacccagcgcttttgctacttttttaagatccagttgacctgcgaccggcgtaacggccacggcaaggtgtttcatatcaccgttcactgccaccagcagcgttttgtagacctgatccggattcaaacctaattttttgacgacttcatcgccaaaattggtttcagccggatcgtgctcgtaggtatggatttgaaacgaaatcttgtttttttcgagtaatttaactgcgggtgtcatggtaattttcctgccttaaacaaaaaaacgaagcaagcatacgcctgatggcggtccaaaaaaaagagtcatcttgcctaagagtattggcaggatggtgagattgagcgacaatcgagttacaccgtcgcttaaagtgacggcataataataaaaaaatgaaattcctctttgacgggccaatagcgatattggccatttttttagcgcaacatttgcggcaaattcccttctccatacaggtgtagtgcaccgaccgcgaccacatatcgccccggcggcatggcgcgtaatttatcccgccaggcgagatttcgctgatgcatcagcacatcgtacagcgactgactgaacgtattgggcagcgttatatcattattttgcggcggtgcattcagccaccagctcatcatttgttgcagcaaccgtgcgttggtatgccagtgggtcagcgtatcgtccagcagcgccagtcctttgtcagggagctggagcaacatggcaatctggttttcagccccttccagttcaatcacgggtttatgttgttgcttcgccgcctgcaatagctggtaatcgataccgtattctgcccgcagccccagtttttgtgcctgcgtcgcctgaagaaccatcgcgatttgccacagcggttgggtagaaaagagtgagggagaaatgcccatctcctggctaatgtgctgcaggttttggagttgctcctcgctaatgcgctcttccagcgcctcgcaggcaggcaaattagcaaaaggcgtatcgctggtggaaacatccgcctcgacgatcagcgcatcggcgtttttgagctttttgagcaaacgggtgggcaggggagccatatcgtggctacccatatgaatactgccaatcagatgaaaatggcgattgccggggagggtgatatcgatggcaggccaggtgtaatgattaccgcgcagcgcggcccaaagcgtttttacccggtacaacagatccatacgacctccctttgtgaaatatcatgctagcgcgcggtgagggatggcgcaaatggagttggagacttgtttaatgtgtttgtatgattcagtatgttcttgcatcgctattcacaaggaagcaacagttaaaaaccatgaaacaggcaacaagaaaaccgacgacacccggagatattcttctctatgaatatctggaaccgctcgatttgaaaatcaatgagttagcagagttgctgcatgttcatcgtaatagcgtcagtgcactgatcaataacaatcgtaaactcactactgagatggcatttcgtctggcgaaagtttttgataccacagtcgatttttggctaaacctccaggcggcggttgatctttgggaagttgaaaacaacatgcgcacccaggaagaattgggacggattgaaacagtggctgaatatttggcacgccgtgaagagcgtgcaaaaaaggtcgcgtaaggccaaaacatcgcttcatctcgtaggccggataaggcgttcacgccgcatccggcatccgagcaccattgcctgatgcgacgcttacccgtcttatcaggcctacaaacttgtgcctgaaccgtaggccggataaggcgtttacgccgcatccggcatccgagcaccattgcctgatgcgacgcttacgcgtcttatcaggcctacaaacctgtgcctgaaccgtaggccggataaggcgtttacgccgcatccggcagtcatgcgtcgatgccaaatgcgccaccctaaagcagcgcatccgcaatgatgtacttattccttcggtttaaaccgcagcaaccggttggcgttactcactacggtaatcgacgagagcgccattgccgctccggcaactaccgggttaagcagtgttccagtgaacggccacaaaataccggcggcgaccggaataccgatactgttgtagataaacgcaccgagcaggttctgcttcatgttgtgcagcgttgcgcgggaaatagcgagcgcatccgcaacgcccatcaggctatggcgcatcagggtaatcgccgcggtttcaatggcaacatcactgccgccacccatcgcaatgccgacatccgcctgagccagcgctggcgcgtcgttaatgccgtcgcccaccattgccacctgacgtccttcactttgcagatgtttgatcgcttcggctttaccgtccggcagcaccccggcgatcacctcatcaatccctgcttctttggcgatcgcattggcggtggttgggttatccccggtcaacatcaccagacgatatcccgctttatgcaggcgttgcagcgccgccacgctatcactacgcaacggatcgcgtactgccagcagggctaccgctttcccgtcaaccgccagcagcacaggcgttgccccttgcgatgcctgagcagtaatctccgcttcgatagctttggtaccaacctgttgctcatttaacagcgcctgattgcccagcaataacgcatgaccttcagcttcaccgctcacgcccagcccgcgcaatgtgcggaaaccgttgacctgcggtagctgcatatcacctgctttatcgaggatcgctcgtgccagcggatggctggaaccttgctccagtgccgccgccagacgcaatgcctgcgcttcatcaacatcagcaaatgttttcactgcgacaacctgcggcttcccttcagtcagcgtcccggttttatcgaacactacagtgtcgagtgtactggcgcgttgcagcgcgtcagcgtcccgcaccagcacgccaaactcagccgcccgcccgacgccggaaataatcgacatcggcgtcgccagccccagcgcacacggacaggcaataatcagtaccgtggtggcaatcaccagggtatagacaatctgcggtgccggaccaaagaaataccagattgccgcactgacaagcgcaataaccaccactaccggcacaaatacggctgagattttatccgccagctgaccgatttctggcttgctgctctgggcctggcgcaccatgcgaatgattcgtgacagcgtagtatggctgccaaccgcactggcacgaaacagcacactgccgtcctgtaccactgtcccggcatggacgctatcgccttcgcctttttgctgcgggattggttcgcccgtcagcatcgcttcatccagccatgcttcgccctgggtaatctcgccatctaccggcacgcgatcgccggtcgtcaggcgcagcaacatacctggctgcacttctgccagaggcacgcttttttcaccttcgtcagtaaccaggcgtgccgtcggcggggttaaatcgagtaacttttccagcgccttagaagaacgctggcgtgcgcgcgcttccagcatatggccgagattgatcagaccgataatcatcgcgctggcttcgtaataaagatgtcgcgcttccatcgggaaccactgcggccacaggttgacgctcatcgaatagagccacgccacgccagtacccagcgccaccagcgtatccatcgtcgccgcaccgttcagcaggcttttccatgcactgcggtaaaaatggccgccggcgaaaaccatcactgccagggttatcaggccgataaccaaccacaggctgcggttgtcagcggtgaccatcatgttatcgccgatcatcccccagaccatcaccgggatacccaccgccagtgcgacaattgcctgccagcggaagcgcttcatcgtagcgacggcggtttcttgctggcgctcgcggcgtttagcgtcatcttcaatcgcttccgcgccgtagcccgctttttccaccgcctgcactaaatcttgtggggaggcactgcccatcaccagcgcagtacgctccgccaggtttacccgtgcctgagtgacgcccggtacgctttgcagcgcattttgtacgcgggtgacacagctggcgcagctcatgccgctcagcagcaactgctggctgtcatcgtcatcggcggtcgctgccggaagcgcctcagaaaccgctgtcagtgcttccgacgggattgatgactccgccagcggtttagcctttgggtggcttacagatgcgtcataacccgcttgtttgatggtttcgatcagctgttctgcactggcagtcccggtaacgtgcgcttcagtgatagacacatccgcctgctcaacatccggacgctgttcaagactttctttcacgcgtttaacgcagtgaccgcaggacaggccgtccagggtcaggtcgatagtttgtgacataaaacactcctttaagacagttttgactggctgtgataaaggttaaaccttccagcaaggggaaggtcaagaaattaataaaccaggcgggtaaaagtccgtaaagattaaaaaatcggctcgatttgcatcaggattagacatttatctctttgttttcctgtagttaagttgcgggtgctaagttaaatcaggatgcctgaaaatcggcaccggggtgaggaattacctcccgcatctataaaaaggagttaacaaaagatgttagatgcaaacaaattacagcaggcagtggatcaggcttacacccaatttcactcacttaacggcggacaaaatgccgattacattccctttctggcgaatgtaccaggtcaactggcggcagtggctatcgtgacctgcgatggcaacgtctatagtgcgggtgacagtgattaccgctttgcactggaatccatctcgaaagtctgtacgttagcccttgcgttagaagatgtcggcccgcaggcggtacaggacaaaattggcgctgacccgaccggattgccctttaactcagttatcgccttagagttgcatggcggcaaaccgctttcgccactggtaaatgctggcgctattgccaccaccagcctgattaacgctgaaaatgttgaacaacgctggcagcgaattttacatatccaacagcaactggctggcgagcaggtagcgctctctgacgaagtcaaccagtcggaacaaacaaccaacttccataaccgggccatagcctggctgctgtactccgccggatatctctattgtgatgcaatggaagcctgtgacgtgtatacccgtcagtgctccacgctcctcaatactattgaactggcaacgcttggcgcgacgctggcggcaggtggtgtgaatccgttgacgcataaacgcgttcttcaggccgacaacgtgccgtacattctggccgaaatgatgatggaagggctgtatggtcgctccggtgactgggcgtatcgtgttggtttaccgggcaaaagcggtgtaggtggcggtattctggcggtcgtccctggagtgatgggaattgccgcgttctcaccaccgctggacgaagatggcaacagtgttcgcggtcaaaaaatggtggcatcggtcgctaagcaactcggctataacgtgtttaagggctgatcatgatgaacacggaaggtaataacggtaacaaacctctcggtctatggaacgtcgtttccatcggcattggggcaatggtgggggcggggatcttcgcgctgctggggcaggctgcattgctaatggaagcctcgacctgggtcgcctttgcttttggcggtattgtggcgatgttttccggttatgcctatgcgcgtctgggggcgagctatcccagcaatggcggcattatcgacttctttcgtcgcggattaggcaacggcgtcttttcgctggcgctctcgttactgtacctgttgacgctggcggtgagcatcgccatggtcgcccgtgcttttggcgcttatgccgtgcagtttttgcatgaaggcagccaggaggagcaccttattttgctctacgcgttggggatcattgcggtgatgacgcttttcaactccttaagcaaccatgcggtagggcggctggaagtgatcctcgtcggcattaaaatgatgatcctgttattgctgattattgccggtgtctggtcgctgcaaccggcgcatatttccgtctctgcgccccccagctccggtgcgttcttctcctgtattgggataactttccttgcctatgcgggctttggcatgatggcgaacgcggcggataaagtgaaagatccgcaggtcattatgccacgggcgtttctggtggcgattggcgttaccacgttgctttatatctcgctggcactggttttgcttagcgatgtatcggcattagagttagaaaaatatgccgataccgccgtagcgcaggctgcttctccgctgctcgggcatgtgggttatgtgatcgtcgtcatcggcgctttactggcgacggcttcagccattaacgcgaacctgttcgccgtgtttaacatcatggacaacatgggcagcgaacgcgaactgccgaagctaatgaataaatccctgtggcggcagagtacctggggcaacattattgtcgtggtgttgattatgctgatgacggcggcactgaatttaggctcactcgccagcgttgccagcgccacctttttgatttgctacctggcggtgtttgtggtggcgatccgcctgcgtcatgatattcacgcctcgttgccgattcttatcgttggtacgttggtgatgttgttggtgatcgttggctttatctacagtctgtggtcccagggtagccgtgcgttgatatggattattggctcactcttactcagccttattgtggcaatggtcatgaagcgcaataaaaccgtataacatctctctgtgcgcagtacttcctgtattattgtggtggcggtcgatattcgcactggcaaaaaaacgtgcttgaatatctgttgaaaccctttaacaaagcacaggaggcgttgcgcgaacgatgaacatcagcgatgtagcaaaaattaccggcctgaccagcaaagccattcgcttctatgaagagaaggggctggtgacgccgccgatgcgcagcgaaaacggttatcgcacctacacgcagcagcatctcaacgaactgaccttactgcgccaggcacggcaggtgggctttaacctggaagagagcggcgagctggtgaatctgtttaacgacccgcagcggcacagcgccgacgtcaaacggcgcacgctggagaaggtggcggagatcgaacgacacattgaggagctgcaatccatgcgcgaccagctgctggcactggcgaatgcctgccctggcgatgacagcgccgactgcccgattatcgaaaatctctccggctgctgtcatcatcgggcagggtgattaagacgagacggctcggatatgtagggttatcccttctatcgcaatgacttcaacatgcgtacctgcaccgagatcctcgctggcgctgacaggccatgaactgtcaccgacgcgcatatgaccgcgcccgttgaccagcggagattccagcacaaaacgtcggccaatcagctgctgcccgcgctggtttaaatgactatcgctgtgcttttgttcgcgcacccgccgcgacaaccatttccaccacagccaggcggcgagcagcgtcaggatggcaaacattaccccttgccactcccaacccagcggcaccagccagaccaccaggccggtaatcaccgctgccacgccgctccacaacaaataaccatttccgcccagcatctcggctgccagcagcaaaccgccgagactgagccagaaaatatgtggatgaacgaccattaactccatcatggctgagtccgtttgttggcgctgtctttcaccagctcggcaatcccggcaatcgaccccatcaggctgctggcctctaatggcatcatcactactttgctgttactggaggaaccgatctgctgtaacgcttcggtgtatttctgcgctacgaagtagttcaccgcctgaatatcaccggaggcgatagcttcagacaccattttggtggcgcgggcttctgcttcggcggaacgttcacgcgcttcagcctgtaaaaacgccgactgacgttcgccttccgctttcaggatttgcgactgtttttcaccttcggctttgaggatttccgcctgacggatcccttccgcttcaagaatgtaagcgcgtttggtacgttccgctttcatctgcgcgttcattgaagagataagctctgccggtgggcgcacgtcgcgaatttcaatacgggtgactttaatcccccacgggttggtggcttcatcgacaatacgcagcaggcgtgagttgatgctgtcgcgctgagagagcatttcgtcaagttccattgaacccagcacggtacggatgttagtcatggtcaggttgatgatcgccagctccagattgctgacttcataagccgcgcgcggcgcgtcaatcacctgaataaagcacacggcgtcgatggtaacgttggcgttatctttcgagataacttcctgggaagggatatcgagcacttgctccatcatattgatcttgcgaccaatgcgatccataaacggcaccaccagactgagccccggctgtaacgttttggtatagcgaccaaagcgttctactgtccactgatagccctgcggtacgattttgacacccgcgccgacaatgaccagcgcgacaaaaatgagaatcgggataaagataagcatcggaaaaacctcctgttgtaccgtccataatcagcaaaattgctgcttgattaaacaaattatacctgattactgaaagagagttcccccttattcctgcgaaggataaactgtttttagtaaaaatcagaaaaagggaacagcgatgcaggaaaatagtcctttgcttcagctacaaaacgtaggatatctggcgggtgatgcgaagattcttaataacatcaatttttcgctgcgtgctggcgaatttaagttaattaccggtccttctggttgtggcaaaagtacgctgctaaaaatagttgcttcattgatcagcccaaccagcggaacgttactgtttgaaggtgaggatgtcagcacactaaagccagaaatctaccgccaacaagtctcttactgcgcccagacaccgacgctgtttggcgatacggtatacgataatctgatctttccctggcagatccgtaaccggcagcctgacccagccatttttctcgattttctcgaacgcttcgccttgccggacagcattttgacgaagaatatcgccgagctatctggtggtgaaaaacaacgcatctcattgattcgtaacctgcaatttatgccgaaggttttattgctggatgaaataaccagtgcgctggatgaaagtaataaacataacgtcaatgagatgatccatcgttatgtgcgcgagcaaaatattgccgtgctgtgggtgacacacgataaagacgaaattaatcatgcggataaagtgattacactgcaaccgcatgccggagaaatgcaggaagcacgctatgaactcgcataatattactaacgaatcattagcactggcattaatgctggtggtggtggcaatcttaattagccataaagaaaaactggcgctggagaaagatattctctggagcgtcgggcgagcgataattcagctgattattgtcggctatgtgctgaagtatattttcagcgtggatgatgccagcctgacattattgatggtgttatttatctgctttaatgcggcgtggaacgcgcaaaaacgcagtaaatatattgctaaagcttttatctcatcgtttattgccattacggtcggggcgggaattaccctggcggtgctgattctctcagggtcgattgaatttatcccgatgcaggtgatccctatcgccgggatgattgccggtaacgccatggtagcggtggggttgtgttacaacaatttagggcaacgggtcattagcgaacagcaacagattcaggagaaactgagtcttggtgcgacgccgaagcaggcttcagcgatattgattcgcgacagtattcgcgcggctttaattccgacggtcgattcagcaaaaacggttggcttagtgagtttaccaggaatgatgtccgggctgatatttgccgggattgatccggtgaaggcgattaaatatcagattatggtgacctttatgctgctctcaaccgccagcttgtcgaccattattgcctgctatttaacctatcgtaagttttataattcgcgccaccagttggtggtgacgcaattgaagaagaaatgatgcgatgccggatgcgcagcatcgcatccggcgttgtggttcatgtgccgatcaacggaatatcaatacaacaatgcatacagctggcggcgatacttcgacgccagtgcatcacccgtacccagcgcagcgaggatctcctggaacgttttacgcgtctgaccgtctgcggcggtgagatctttacgcagatgcccgaacagcaactccagcgcctcttcattgcgcccaacctgatgcagttgcagcgccagttgcgtcgccagtgcggcatcttctggattctccgccacctgctgttgcaactgttgaatttccggcgtatcagccgcctgcttcagcagttcgatttgcgccaccagcccctggtagcgggtgtcctgatcctgcaacggaatggttttcagcaccgcttccgcatcttcagaacggttcagcgcaatcagcgtttctgccagcagcaggccgatctccccgttctgattcgacaactgccaggcgtctttcagcaatggcagggcatcggtgtaattgctttcctgcatcagttgcatcgcctgctgcgctttcagctcttcttcgcgcggcagcactttatccagcagggcgcggatcgcctcttccggttgcggcccctggaagccatctaccggttgcccgttctggaacagatacacggtcggaatcgcacgcagaccaaactgcgcggcaatcatctgctccgcgtcgcagtccagcttcgccagaataaattgcccgttgtactgcgccgcgaggctttccagaattggggttaactgcaaacagtgctggctacgttcagaccaaaaatagaacagcaccggagtggtcatcgactgttcaagaacctgttgcaggttagattcgttaatgttgacaatattttctacggacatggagtcgctctctgttgtcgatattttctttgacatgggggcttaagcgcgcgcttcaactcacccctgcaatattttgtccatcacgcgccccggcagcaggcgcttaagcaccattaccgcccaggtcaccagcgtcaccggatagcgcatcttcggcttctcgctaataaaagcatggcgtactttgtccaccaccgcttccggtcccaacgtaaagcgggcggcgatgccgggattttcgactggtttatcactttgcgtctggttgacgttgtcggtgaagcgagtacgaatgggaccgggttcgatcaggctgactttaattccgctgtggcgcagctccatgcgcagtgcatctgaccacgcctccagcgcatatttactggccgcgtaagcgccacgacccggcgtggagattaatcccatcaccgatgatgtcatcacaatacgcccttcaccgtgcggtaacatcgcgggtaacaggcgcatggtgagctggtgtgcgccgaaaaagttggcggaaaactgctgttccatctgcgcacggctgatggtggaaagggggccatacatgccgaatccggcattgttaaagatcccatacagacaattatcggtcagggcgatcacctcgtcggctgcgcgatcaacactttctggtgaatccagatcgatcaacacgccggtaaatcccatgctgttcatgcgctcaacatcatccggtttccggcaacctgccagcacatgaaaaccctggcgttttaattcgagcgcgctttccaggccaattccactggaacatccggtaattaagaccgatttttgcataactttacctgtcaggatctccgttgctttatgagtcatgatttactaaaggctgcaactgcttcgccatccagtcggcaataaacggctgggcgtcgcggttgggatgaataccgtcatcctgcatccattgtggcttgaggtagacctcttccataaaaaagggcagcagcggaacatcaaactctttggcgagtttggggtaaatggcgctaaaggcttcattataacggcgaccatagtttgcaggcagacgtatttgcattaacaatggttcagcgttggcggctttgacatcctgcaaaatctggcgcagcgtttgctcggtttgctgtggctgaaaaccacgcaaaccgtcattgccgcccagttcaaccagcacccaacgcggctgatgctgtttcagcagagccggaaggcgcgccagtccttgttgcgaggtgtcgccgctgatgctggcattaactaccgacgttttactctgccacttatcattcaacaaggcaggccaggccgcgctggcagacattcgatacccggcgctcaggctatcacccagaatcaataacgtgtccgctgcggcggcacggaaggttaacaggaccaggaacaggaagggcaaatgccagcggaaaacattgttgaagttcatcatcttaagaagtccgtcggtcagggggagcatgaactctccatcctcaccggagttgagctggttgtcaaacgtggcgagaccatcgcactggtgggcgagtcgggatcgggtaagtcaaccttgctggcgatcctcgccgggcttgatgacggcagcagtggcgaagtgagtctggtgggacaaccgctacataatatggacgaagaagcgcgggcaaagttgcgcgcgaagcacgtcggctttgtttttcagtcatttatgttaattcctacccttaacgcgctggaaaacgtcgagcttccggctctgctgcgcggtgagagtagcgcggaaagtcgtaacggggcgaaagcgttgctcgaacagttagggctgggtaaacgtctggatcatcttccggcacagctttccggcggtgaacagcaacgagtggcgctggcacgagcctttaatggtcgacctgatgtgctgtttgccgacgaacccaccggcaaccttgaccgccagacgggcgataaaattgccgacctgctgttttccctcaaccgtgaacatggcaccacgttgattatggtgacccacgacctgcaactggcggcacgctgcgaccgctgcttacggctggtgaacgggcagttgcaggaggaagcatgattgcacgttggttctggcgcgaatggcgttcgccgtcgctattaattgtctggctggcgctaagcctggcggtggcctgcgtgctggcgctgggcaatatcagcgatcgcatggagaagggcttaagccagcaaagccgtgagtttatggcgggcgatcgggcgttgcgcagttcacgcgaagtgccgcaagcgtggctggaggaagcgcaaaagcgcggcctgaaagtcggcaagcagctgactttcgccacaatgacctttgcaggcgacacaccgcagctggcgaacgtcaaagcggtggatgatatctacccgatgtatggcgatctgcaaactaatccccctggcctgaaaccgcaggcgggcagcgtattgctggccccacgcctgatggcactgcttaacctgaaaacgggcgacaccattgacgtgggcgatgccaccttgcggattgccggagaagtgattcaggaaccggattccggttttaaccccttccagatggctccgcgtctgatgatgaatctggcggatgtcgataaaaccggagccgtgcagccggggagtcgggtcacctggcgttataaattcggcggcaacgagaaccagctcgacggctatgagaaatggttgttacctcagcttaaacccgaacaacgctggtacggtctggaacaggacgaaggcgcgctggggcgatcgatggaacgctcgcaacagttcctgctgctttcggcgcttctgaccttgctgctggcagtggcagcggtggcggtagcgatgaatcattactgtcgcagtcgctacgatctggtggcgatcctcaaaacgctgggggcagggcgagcgcaactgcgtaagctaatcgtcggtcagtggttgatggtgctgacgctttcagccgttaccggtggggccataggcctgttgttcgaaaacgtgttgatggtgctgctcaagcccgttctgcctgctgcactaccgccagccagcctctggccgtggctgtgggcgcttggcaccatgacggtcatctcgctgctggtggggctacgaccatatcgcttgttgctggcaacgcagcctttacgcgtattacgtaatgatgtggtagcgaacgtctggccgctgaagttttatctgccgattgtcagtgtggtggttgtgctgctgctcgccggattaatgggtggcagcatgctgctttgggcggtgctggcgggcgcggtagtactggctttgctgtgcggtgtgctgggctggatgctgctgaatgtacttcgccgcatgacgctgaaatcgctgcctctgcgcctggcggttagccgcctgttacgtcagccgtggtcaacgttaagtcagctttcggcattttcgctctcctttatgctgctggcactgctgctggtgttgcgtggcgatctgctcgaccgctggcagcagcagctacctccagaaagcccgaactactttttaattaacatcgccacagaacaggtagcaccgctaaaagcgttcctcgcggaacatcagatagtcccggaatcgttttatccggtggtgcgggcgcggctgacggcgattaacgataagccgacagaaggtaatgaagatgaggcgcttaaccgcgaactcaatcttacctggcaaaatacgcggcccgatcataatccgattgtcgccggtaactggccgccaaaagccgatgaagtgtcgatggaagaggggctggcgaaacgcttaaacgttgccctcggtgataccgtgacttttatgggcgatacccaggagttccgcgctaaagtgaccagcctgcgcaaagtggactgggaaagtctgcggcctaatttctattttattttccctgaaggggcattagacgggcaaccgcagagctggcttaccagtttccgctgggagaatggcaacggcatgttgacacaactcaaccgccagttcccgaccattagcctgttagatattggcgcgattttaaaacaggtcggtcaggtgctggagcaggtaagtcgggcgctggaagtgatggtggtactggtcaccgcctgcggtatgttgctgttgctggcacaggtgcaggtgggaatgcgtcagcgtcatcaggagctggtggtgtggcgcacactcggtgcggggaaaaaactgctgcgtaccacgttgtggtgtgagttcgccatgcttgggtttgtttccggcctggtggccgcaattggtgcggaaacggcgctggcagtgttgcaggcgaaagtgtttgattttccgtgggagccagactggcgattgtggattgttctgccgtgcagcggagcgctgctgctgtcgcttttcggcggctggctgggtgcgcgactggttaagggtaaggcgctgttcaggcagtttgcggggtgatgagagtaaataaggggcgttctggttgaatggaacgccttgtttaaattaattctacaatatgtttcattgatgatgttattgaattggtgatttcctatctttctattgctgatattaatctgaatcggtggagtttattgattttaaatatagccctacaaaaataactcagactaataaaatcataaatcatatgcgttgaatggatattatccatatagtgaatttgttgatgatgaattcatctgtgctaaaaatgttagtttaataaaatattgaaagtgacctgtaataacagttgttgttgattgagaacaaataagtttatgtgaaaaatatataaatacattagctggtcttgtgtgtcattttatttttttttgttgctaacacagggatatgaacaataactaaaagggcactttatatgagcggaaaaccagcggcgcgtcagggagatatgactcagtatggcggtcccattgtccagggttcggcaggtgtaagaattggcgcgcccaccggcgtggcgtgctcggtgtgtccgggcgggatgacttcgggcaacccggtaaatccgctgctgggggcgaaggtgctgcccggcgagacggaccttgcgctgcccggcccgctgccgttcattctctcccgcacctacagcagctaccggacgaagacgcctgcaccggtgggcgttttcggccccggctggaaagcgccttctgatatccgcttacagctacgtgatgacggactgatactcaacgacaacggcgggcggagcattcactttgagccgctgctgccgggggaggcggtgtacagccgcagtgagtcaatgtggctggtgcgcggtggtaaggcagcacagccggacggccatacgctggcgcggctgtggggggcgctgccgccggatatccggttaagcccgcatctttacctggcgaccaacagcgcacaggggccgtggtggatactggggtggtctgagcgggtgccgggtgctgaggacgtactgccagcgccgctgccgccgtaccgggtgcttaccgggatggcggaccgcttcgggcggacgctgacgtaccggcgtgaggccgccggtgacctggccggggaaatcaccggcgtgacggacggtgccgggcgggagttccgtctggtgctgaccacgcaggcgcagcgtgcggaagaggcccgcacctcttcgctatcttcttctgacagttcccgccctctctcagcctcagcgttccccgacacactgcccggtaccgaatacggccccgacaggggtatccgcctttcggcggtgtggctgatgcacgacccggcatacccggagagcctgcccgctgcgccactggtgcggtacacgtatacggaagccggtgaactgctggcggtatatgaccgcagcaatacgcaggtgcgcgctttcacgtatgacgcgcagcacccgggccggatggtggcgcaccgttacgcgggaaggccggagatgcgctaccgctacgacgatacggggcgggtggtggagcaactgaacccggcagggttaagctaccgctatctttatgagcaggaccgcatcaccgtcaccgacagcctgaaccggcgtgaggtgctgcatacagaaggcggggccgggctgaaacgggtggtgaaaaaagaactggcggacggcagcgtcacgcgcagcgggtatgacgcggcaggaaggctcacggcgcagacggacgcggcgggacggaggacagagtacggtctgaatgtggtgtccggcgatatcacggacatcaccacaccggacgggcgggagacgaaattttactataacgacgggaaccagctgacggcggtggtgtccccggacgggctggagagccgccgggaatatgatgaaccgggcaggctggtatcggagacatcgcgcagcggggagacagtacgctaccgctacgatgacgcgcacagtgagttaccggcgacgacaacggatgcgacgggcagcacccggcagatgacctggagccgctacgggcagttgctggcgttcaccgactgctcgggctaccagacccgttatgaatacgaccgcttcggccagatgacggcggtccaccgcgaggaaggcatcagcctttaccgccgctatgacaaccgtggccggttaacctcggtgaaagacgcacagggccgtgaaacgcggtatgaatacaacgccgcaggcgacctgactgccgttatcaccccggacggcaaccggagcgagacacagtacgatgcgtggggaaaggcggtcagcaccacgcagggcgggctgacgcgcagtatggagtacgatgctgccggacgtgtcatcagcctgaccaacgagaacggcagccacagcgtcttcagttacgatgcgctggaccggctggtacagcagggcggctttgacgggcggacgcaacgttatcattatgacctgaccggaaaactcacacagagtgaggatgagggacttgtcatcctctggtactacgatgaatcggaccgtatcactcaccgcacggtgaacggcgaaccggcagagcagtggcagtatgatggccacggctggctgacagacatcagccacctgagcgaaggccaccgtgttgccgtccactatggctatgacgataaaggccgcctgaccggcgaatgccagacggtggagaacccggagacgggggaactgctgtggcagcatgagacgaaacacgcatacaacgagcaggggctggcaaaccgcgtcacgccggacagcctgccgccggtggagtggctgacgtatggcagcggttacctggcgggaatgaagctgggcgggacgccgctggtcgagtatacgcgggacaggctgcaccgtgagacggtgcgcagcttcggcagcatggcaggcagtaatgccgcatacgaactgaccagcacatacacccccgcaggccagttacagagccagcacctgaacagcctggtatatgaccgtgactacgggtggagtgacaacggcgacctggtgcgcatcagcggcccgcgacagacgcgggaatacggctacagcgccacgggcaggctggagagtgtgcgcaccctcgcaccagacctggacatccgcatcccgtatgccacggacccggcgggcaaccggctgccggacccggagctgcacccggacagtacactcacagtgtggccggataaccgcatcgcggaggatgcgcactatgtctaccgccacgatgaatacggcaggctgacggagaagacggaccgcatcccggcgggtgtgatacggacggacgacgagcggacccaccactaccactacgacagccagcaccgcctggtgttctacacgcggatacagcatggcgagccactggtcgagagccgctacctctacgacccgctgggacggcgaatggcaaaacgggtctggcggcgggagcgtgacctgacggggtggatgtcgctgtcgcgtaaaccggaggtgacgtggtatggctgggacggagacaggctgacgacggtgcagactgacaccacacgtatccagacggtatacgagccgggaagcttcacgccgctcatccgggtcgagacagagaacggcgagcgggaaaaagcgcagcggcgcagcctggcagagacgctccagcaggaagggagtgagaacggccacggcgtggtgttcccggctgaactggtgcggctgctggacaggctggaggaagaaatccgggcagaccgcgtgagcagtgaaagccgggcgtggcttgcgcagtgcgggctgacggtggagcaactggccagacaggtggagccggaatacacaccggcgcgaaaagctcatctttatcactgcgaccaccggggactgccgctggcgcttatcagcgaagacggcaatacggcgtggagcgcggaatatgatgaatggggcaaccagcttaatgaggagaacccgcatcatgtgtatcagccgtaccgtctgccagggcagcagcatgatgaggaatcagggctgtactataaccgtcaccggtactacgatccgttgcaggggcggtatattactcaggacccgatggggttgaaagggggatggaatttatatcagtatcctttaaatccactacaacaaattgaccctatgggattattgcagacttgggatgatgccagatctggagcatgtacggggggagtttgtggtgttctttcacgtataataggaccaagtaaatttgatagtactgcagatgctgcgttagatgctttgaaagaaacgcagaatagatctctatgtaatgatatggaatactctggtattgtctgtaaagatactaatggaaaatattttgcatctaaggcagaaactgataatttaagaaaggagtcatatcctctgaaaagaaaatgtcccacaggtacagatagagttgctgcttatcatactcacggtgcagatagtcatggcgattatgttgatgaatttttttcaagtagcgataaaaatcttgtaagaagtaaagataataatcttgaagcattttatctcgcaacacctgatggacgatttgaggcgcttaataataaaggagaatatatttttatcagaaatagtgtcccgggattgagttcagtatgcataccgtatcatgattaattttagtgcttttattagtggggcctataaggagattcaatgaaatatagttcaatattttcgatgctttcattttttatactatttgcctgtaatgagacagctgtttacggttctgatgaaaacattatttttatgaggtatgtggaaaaattacatttagataaatactctgttaaaaatacggtaaaaactgaaacaatggcgatacaattagctgaaatatatgttaggtatcgctatggcgaacggattgcagaagaagaaaaaccatatttaattacggaactaccagatagttgggttgttgagggagcaaagttaccttatgaagttgcgggtggtgtatttattatagaaattaataagaaaaatggatgtgttttgaatttcctacatagtaaataatgctggcgctgatggatgcggatggaaacattgcgtggagcggggagtatgatgagtggggcaaccagctgaatgaagagaacccgcatcacctgcaccagccgtaccggctgccggggcagcagtatgataaggagtcggggctgtactacaaccggaaccggtactacgatccgttgcaggggcggtatatcactcaggacccgatagggctggaggggggatggagtctgtatgcgtatccgctgaatccggtgaatggtattgatccattagggttaagtcccgcagatgtagcgctaataagaagaaaagatcaactaaaccatcaaagagcatgggatatattatctgatacttatgaagatatgaagagattaaatttaggtgggactgatcaatttttccattgtatggcattttgtcgagtgtctaaattaaatgacgctggtgttagccgatcggcgaaagggctgggttatgaaaaagagattagagattacgggttaaatctgttcggtatgtacggcagaaaagtaaagctatcccattctgaaatgattgaagataataaaaaagacttggctgtaaatgaccatgggttgacatgtccatcaacaacagattgctcagatagatgtagtgattatattaatccagagcataaaaaaacgataaaggctttacaagatgctggctatctcaagtaatctatcaaagatgataatatttatttttgctattataatcattgttgttttatgcgtaattacttatctttatttatacaaagatgaatctcttgtaagtaaacattacataaactatatggcaataccagaaaatgatggagtttttacatggctcccagatttttttccgcacgtagcggtggatatatcaatatacacaaatgtagaagatgattatttttttcttatttttccctaacaaatgatgatgggggtaggtttaagaaaacattgacagtgagggccagggaacaagtggcgaaaatcgtatcaaagaatgatccagatacaaaaaaagtgtggtgtaaatatggtaagataccagggcaaggggatggtgtaaaccttttttttgttggtgaaattaatgttacgcattattttataacaaatattggagctggattgcctgatgcttgtgcagagtaattgcttgaattaagagtctatcccatatcgaagtcgtcaacttcgtagtgaggaaaagtaaaattcctgactgagaaaagacatgtcggctattgtgtaaagccatatagctcagacgatgaatatctactcgtattcagttgtttattgagggtgagttccgaccctgaaacaacaaataaaatgaacagtcagagagtttacatagaattgcactggtcttttacgatatctgacattgtgtaatacatattcagccatgcattaattaaaatgttacgtgtttaatgtgagtccctatctgaaaataaataatccttccggattaaaataaattcttgccgggaaagaaagaggaaataaaccattagcggaaaaccagcggcacgccagggtgacatgccccagtacggcggcccgatagtccagggttcagcgggggtactgatagtcgcgccgactgcatcgagaactccatacaactttttacggaacgtcacctgataaaatttgttcagtatcgtcttttgagattctcaaggttatggagtaaccagacagaacggacaccactgtcggagataaaaaccccctgtttacgcagctcgttgctggcccggtgctgaccatgtgtcgggaaagcgacggcgtaatcaacaacagcctgttcagttgcctcatcggtacggttcttaaggttaggagcgcggcgactacgattaatctgcgcatccacaccgccttcagcgaccagttcgcggtaacgataaaacgtatcacgcgaaacgcccatgattttacaggcttttgatacgttgctgagttcttcagccagattgagcaaaccggctttgtgtttgatgacgggattggcagtatgaagcatgagagttacctcttgttttggataaggattcgacactcatatcaaaaccggtaactctcaacctttcaaggccatgtgtcagatcaagtcgcgactaatacaaatacgtccctcattaccgcgccttaacccattccgccacttccgcccactcaccgcgaaagacaactttttccgcttttttctcaagctgatagcgatacatcgggtcgtaatattcttcaagtaacggcaccagccaggccagatgaccgtcggtgctgccggtggtgagttgcgttgtcagtgctgcatccagccttgcagccagttcgttatagcgctgtagccccagccgacgcttaatcgccgaaagtccgtgatgcaggtattcgcaatactcctgccagccctgttcgtcgccgtacgcgtgggtaaaatcatgatgcatacgcaagaaatactcttcgttcaggcgctcaagacggatctcaaacggatcttctaccaccgcaatcgccgcctgagtcattcgctcgcgcaggcattccggcaggtgattcgaaccgatcatccggctttcgtcttccagcacccacaggcgcaaattctgacgggcgtcggtttttagcatttcggcagccagcaggttttcaaaactcgcctggctaagttgtggttgtaacgtgcgaccaaacgccgaaccgcgatgacgcgccaacccttccagatcaacaccgttcggctgttgctgcactaacagcgttttaccgctgccggtacaaccgccaatcagcactatcggtttttgtgccagttcaatagtcgcctgaatcgcggtctggcgcagtgccttataaccgccttccaccagcggataatcaatccccgctgcatgcaaccagctttgcacaatatgtgagcgctgaccgccacgggcgcagcagagaataccttgcggattttgcaggcacgctgcccgccaggcgtccatgcgctgctgacgaatttcacccgccaccagtttatgtcccagcgccagcgctgcgtctgagccttgctgtttatagcaggtgccaacggcggcgcgttcatcgttattcattaacggcagattgatagcggcgggcattgcgccgtgctcaaactcgataggggcgcgaacatcaataatgggcgtatcagcaatcagcagggcacgatagtcctgttccgtgtgtctctcttgcatagttaaaagtgaacctcaaatcagcttgcgcgctattttacgcgccaacgcgcaaggaaacttgatttttaactgcgtgggttgccgaaaatttctaaaaatccgctgatttccggcctgcgctgggtaaacaaggtcacaatatcttctaccgctttgccgctgccaaatttgcgccatgccagactcaatggcgaaggagggcgcatcgttgggattacccggctgaccagttgttgattatcgatcattgactggcaaagcgattttggcaaaaaaccaatgccaacgcccgccagatgggcggcgattttcgtttccatatcgggaacaataatctctttttgccctggcaatcgccaggcgacgcgtttggttaaggtgcgggcgctgtcttcaatattgaccgccggaaagcgccgcaactgcgcttctgttagcggctcttcaacgttcgccagcggatgatccgccgccatgacaaagcgccattgcaccgatcctaagggatcaagactaaaggtatttgccagcgcctcagttcccgtgacgccgatagccagcgaaaaaccttcgtacaatagcgagtcccagacgcccatatagatttgtcgggagatgtgaaactgggtaaaggggtaacgctcattcagccacgccagcaactgggcgacggcctgggggttgtagagcaggttgttgatgacaatattcacctggcgttccacgccatcattcacctgttgcagctcgcttggcatactttccagccagctcagccagtctctggcctgggaaagtagatgctcgccagccgctgtcaacgtcacgctgcgagtcgtacggaaaaacagcgctactccggtattctcttccagaagtttaatgcgataactgatcgtcgccgtggttttacataatcgttctgccgcttttgaaaaacttcctgtttcagcaaccgcaatgaaagtccgcaaggtttctggatcgaacatcttcaggtatccccttttaaatccgcaagttgcgtgattttcttatcctctgatttatcagtatttttacatgataaccctgttcaatttgtggactaaatctagttttggaaaaatattccaacttttgtattgatgttgttctcttaaggttttagattgcctgttattgaaaccaagctgaccggtcggcggtggttgaacggaattatgttacaaggacaaaaagatgaaacttcaggtattaccgttaagtcaggaagcctttagtgcttatggcgacgtaatcgaaacgcagcaacgggattttttccatattaacaatggcctggtggagcgttaccacgatttggcgctggttgagattcttgagcaagactgtacgcttatcagcattaaccgcgcgcaaccggcgaatctgccgctgaccattcacgaactcgaacgtcatccgctgggtactcaggcctttatcccgatgaaaggtgaggtgtttgtggtggtcgtggcgttaggtgacgacaaaccagacctgtcaacgctgcgggcgtttatcaccaacggcgaacagggagtgaattaccatcgtaacgtctggcatcacccacttttcgcctggcagcgcgtcaccgattttctgaccatcgatcgcggcggcagtgacaactgtgatgttgaaagtattcctgaacaggaactctgttttgcgtgacgcctgcaaccgacttgcataagataaactaattgttcattgtttatgctcacttgtaggtcggagttaacgtaggtatgacggaagttagacggcgcggcaggccaggacaggcggagcctgtggcacagaagggcgcacaggcgttagagcggggaattgcgattctgcaatatttggaaaaaagtgggggaagttcgtcggttagcgatatttctctcaatctggatttgccgctctccacgacctttcgcttgctgaaggttttacaggcagcggattttgtctatcaggacagtcaattaggctggtggcatataggattaggtgtctttaacgtcggtgcggcgtacatccataaccgcgatgtcctctccgtcgccgggccgtttatgcgccgcctgatgttactttccggcgaaacggtcaatgtcgcgatccgtaacggcaatgaagcggtattaattggtcagttagagtgtaaatcgatggtcaggatgtgtgcgccactgggcagtcgtctgccactgcatgcttccggtgcgggcaaagcgctgctttatccgctggcggaagaggagttgatgagcatcattctgcaaaccggtttgcagcagtttacgccaactacgcttgtggatatgcccaccttgctgaaggacctggaacaagcgcgtgaactgggctataccgtagataaagaagagcatgttgtaggtctgaattgcatagcttcagcaatttacgatgatgtcggtagtgttgttgccgctatctccatctccgggccttcatcaagactgacagaagatcgttttgtcagtcagggtgagctggtcagagacaccgcccgcgatatcagcacggcgttgggactgaaagcacatccataatgtctgtcgcatcccgctctgcggagcgggtttttttgacaaaatttgaaagttggaaaaattttccaataaatagaggtaggaataaaatggcaaaaatgagagccgttgacgcggcaatgtatgtgctggagaaagaaggtatcactaccgccttcggtgttccgggagctgcaatcaatccgttctactcagcgatgcgtaagcacggcggtattcgtcacattctggcgcgtcatgtggaaggtgcttcgcacatggcggaaggttatacccgcgcaacggcagggaatatcggcgtatgtctggggacttccggtcctgcgggcacggacatgatcaccgcgctctattccgcttctgctgattccattcctattctgtgcattaccggccaggcaccgcgcgcccgtctgcataaagaagattttcaggccgtagatattgaagcaattgctaaaccggtcagcaaaatggcggttacagttcgtgaagcggcgctggtgcctcgcgtgctgcaacaggcatttcacctgatgcgttctggtcgtccgggtccggtactggtggatttaccgttcgacgttcaggttgcggaaatcgagtttgatcctgacatgtacgaaccgctgccggtctacaaacctgctgccagccgtatgcagatcgaaaaagctgtagaaatgttaatccaggccgaacgtccggtgattgttgccgggggcggggtaattaatgctgacgcagctgcactgttacaacagtttgctgaactgaccagcgttccggtgatcccaacgctaatgggctggggctgtatcccggacgatcatgaactgatggccgggatggtgggtctgcaaaccgcgcatcgttacggtaacgcaacgctgctggcgtctgacatggtgtttggtatcggtaaccgttttgctaaccgtcataccggctcggtagagaaatacaccgaagggcgcaaaatcgttcatattgatattgagccgacgcaaattggtcgcgtgctgtgtccggatctcggtattgtctctgatgctaaagcggcgctgacactgctggttgaagtggcgcaggagatgcaaaaagcgggtcgtctgccgtgtcgtaaagaatgggtcgccgactgccagcagcgtaaacgcactttgctgcgcaaaacccacttcgacaacgtgccggtgaaaccgcagcgcgtgtatgaagagatgaacaaagcctttggtcgcgatgtttgttatgtcaccaccattggtctgtcacaaatcgctgcggcacaaatgctgcatgtctttaaagaccgccactggatcaactgtggtcaggctggtccgttaggctggacgattccggctgcgctaggggtttgtgccgctgatccgaaacgcaatgtggtggcgatttctggcgactttgacttccagttcctgattgaagagttagctgttggcgcgcagttcaacattccgtacatccatgtgctggtcaacaacgcttatctggggctgattcgtcagtcacaacgcgcttttgacatggactactgcgtgcaactcgctttcgagaatatcaactccagtgaagtgaatggctacggtgttgaccacgtaaaagtagcggaaggtttaggttgtaaagctattcgggtcttcaaaccggaagatattgcgccagcctttgaacaggcgaaagccttaatggcgcaatatcgggtaccggtagtcgtggaagttattctcgagcgtgtgaccaatatttcgatgggcagcgaactggataacgtcatggaatttgaagatatcgccgataacgcagcggacgcaccgactgaaacctgcttcatgcactatgaataagggagataaataatgttacgtttctctgctaatttatcgatgttatttggagaatatgattttctcgcccgttttgagaaagctgcgcagtgtggttttcgcggcgttgaatttatgtttccttatgactacgacattgaagaattaaaacatgtgctggcgagtaataaactcgaacatacgctgcacaatttaccggcgggtgactgggcggcgggggagcgcggtattgcctgtattcctggccgtgaagaagagtttcgggatggcgtagcagcagcgattcgttatgcccgtgcgctgggtaataaaaaaattaactgtctggtcggtaaaacgccggctggtttcagcagtgaacagattcacgcaacgcttgtagaaaacctgcgttatgccgcgaatatgctgatgaaagaagatattttattactgattgaacctattaaccattttgatattcctggtttccatctcaccggaactcggcaggcgctgaaattgattgatgatgttggttgctgcaatttgaaaattcagtatgacatttatcatatgcagcggatggaaggtgaattaaccaacaccatgactcagtgggctgataaaattggtcacctgcaaattgccgataatccgcatcgcggcgaaccgggaaccggagaaattaattatgattatctctttaaggtaatcgaaaattctgactacaacggttgggttgggtgtgaatataaaccccaaaccaccacggaagccggtttacgctggatggatccgtaccgttaaaacgtaacgctattcagacaatgcttttttaggccgctaagttggcaggggatcgtgttgtctgaattcaggaaaagcgaaatttaaaagaggttaattatgaaactgggatttattggcttaggcattatgggtacaccgatggccattaatctggcgcgtgccggtcatcaattacatgtcacgaccattggaccggttgctgatgaattactgtcactgggtgccgtcagtgttgaaactgctcgccaggtaacggaagcatcggacatcatttttattatggtgccggacacacctcaggttgaagaagttctgttcggtgaaaatggttgtaccaaagcctcgctgaagggcaaaaccattgttgatatgagctccatttccccgattgaaactaagcgtttcgctcgtcaggtgaatgaactgggcggcgattatctcgatgcgccagtctccggcggtgaaatcggtgcgcgtgaagggacgttgtcgattatggttggcggtgatgaagcggtatttgaacgtgttaaaccgctgtttgaactgctcggtaaaaatatcaccctcgtgggcggtaacggcgatggtcaaacctgcaaagtggcaaatcagattatcgtggcgctcaatattgaagcggtttctgaagccctgctatttgcttcaaaagccggtgcggacccggtacgtgtgcgccaggcgctgatgggcggctttgcttcctcacgtattctggaagttcatggcgagcgtatgattaaacgcacctttaatccgggcttcaaaatcgctctgcaccagaaagatctcaacctggcactgcaaagtgcgaaagcacttgcgctgaacctgccaaacactgcgacctgccaggagttatttaatacctgtgcggcaaacggtggcagccagttggatcactctgcgttagtgcaggcgctggaattaatggctaaccataaactggcctgatacccgcaataaaaatggccgatatcagaaaatgaatcggccagcaatattaaaaaagaaagcagccaaagatgttgcttcagtattaaaaataatatttttattttatttgttcctcatagctagattaaaacaacgttattcgatacgtgaaattaagagggatttatggaacatcagagaaaactattccagcaacgcggctatagcgaagatctattgccgaaaacgcaaagccagcggacctggaaaacatttaactattttaccttatggatgggttcggttcataacgttcccaattatgtgatggtcggcggcttttttattctcggcttgtctacctttagtattatgctggcaattatcctcagcgcctttttcattgccgcggtaatggtattaaacggtgctgcgggcagtaaatacggtgtgccttttgccatgatcctgcgtgcttcttacggtgtacgtggtgcactgtttcccggattattaaggggcggaattgccgccatcatgtggtttggtttgcaatgttacgcggggtcactggcctgcttgattctgattggcaaaatctggccgggatttttaactctcggtggtgatttcactctgttaggcctttctctaccgggcttaattactttcttaatcttctggctggtcaacgttggtataggttttggcggtggcaaagttttaaataaattcactgccattcttaacccgtgcatctatatcgttttcggcggtatggcgatttgggcgatttcactggtcgggatcggtccaatctttgactacattccgagcggtattcagaaagcagaaaacggtggcttcctgttcctggtggtgattaacgcggtagttgcggtctgggcggcaccggcggtgagcgcatccgactttacgcaaaacgcccactcgtttcgtgagcaggcgctggggcaaacgctgggtttagttgtggcctatattctgtttgcggtcgccggggtatgtattattgccggagccagtattcactacggcgctgatacctggaacgtgctggatattgttcagcgttgggacagcctgttcgcctcgttctttgcggtactggttattctgatgacaactatctccactaacgcgaccggtaatattattccagccggttatcagattgccgccattgcaccgacaaaactgacctataaaaacggcgtactgattgccagtattatcagcttgctgatctgcccgtggaaattaatggaaaatcaggacagcatttatcttttcctcgatattatcggcggaatgcttggtccggtaattggtgtcatgatggcgcattattttgtggtgatgcgcggacaaattaatcttgatgaactgtataccgcacctggcgattataaatattacgataacggttttaacctcactgcgttttcagtaactctggtggccgttattttatctcttggcggtaagtttattcactttatggaaccgttatcgcgtgtttcatggtttgtcggcgtcatcgtcgcctttgcggcctacgccttattaaagaaacgtacaacagcagaaaaaacaggagagcaaaaaaccataggttaattaatcccgatattgaacattgagttaaaaaccaatctgtattttacaaggagtttgttatgtcttttgatttaatcattaaaaacggcaccgttattttagaaaacgaagctcgcgttgtagatatcgccgttaaaggcggaaaaattgctgctatcggtcaggatctgggcgatgcaaaagaagttatggatgcgtctggtctggtggtttcgccgggcatggttgatgcgcacacccatatttctgaaccgggtcgtagccactgggaaggttatgaaaccggtactcgcgcagcggcaaaaggtggtatcaccaccatgatcgaaatgccgctcaaccagctgcctgcaacggttgaccgcgcttcaattgaactgaagttcgatgccgctaaaggcaagctgactattgatgcggcacaactcggtggcctggtgtcttacaacatcgaccgtctgcatgagctggatgaagtgggcgttgtcggcttcaaatgcttcgttgcgacctgtggcgatcgcggtatcgacaacgacttccgtgatgtaaacgactggcagttcttcaaaggtgcgcagaagctgggcgaactgggtcagccggtgctggtgcactgcgaaaacgcgctgatttgtgacgaactgggcgaagaagcgaagcgtgaaggtcgcgtaaccgctcatgactatgtggcttcgcgtccggtatttaccgaagtggaagcaattcgccgcgtactgtatctggcgaaagttgctggttgccgtctgcacgtttgccacgtcagcagcccggaaggtgttgaggaagtgactcgtgcacgtcaggaaggtcaggacgttacttgtgaatcctgcccgcattactttgtactggataccgatcagttcgaagaaatcggtactctggcgaagtgttcaccgccgatccgcgatctggaaaaccagaaaggcatgtgggaaaaactgtttaacggtgaaatcgactgcctggtttccgaccactctccatgcccgccggaaatgaaagccggtaacatcatgaaagcatggggcggtatcgccggtctgcaaagctgcatggacgtgatgttcgatgaagcggtacagaaacgcggtatgtctctgccaatgttcggcaaattaatggcgactaacgcagcagatattttcggtctgcagcaaaaaggccgtatcgccccaggaaaagatgccgacttcgtcttcattcagccgaatagcagctatgttcttaccaatgacgatctggaatatcgccacaaagtcagcccgtatgttggccgtaccattggcgcgcgtatcacgaaaaccatcttacgtggtgatgtgatttacgacattgaacagggcttccctgttgcgccgaaaggtcaatttatccttaaacatcagcagtaatctggcccctgcaatgcccgtccttgcggcgggcattctccggttaaggtgtgtttatgttcaattttgcagtcagccgcgaaagcctgttatcaggatttcagtggtttttctttattttttgcaacacggttgtggttcctcctacgctactttctgcttttcagttgccgcaaagtagcctgcttacgctcacgcaatatgcttttcttgctaccgcactggcctgcttcgctcaggcgttttgcggtcatcgtcgcgctattatggaagggccaggtggcctgtggtggggaaccatccttactatcacccttggtgaagcatcgcgcgggacaccgatcaacgatatcgccaccagcctggcagtggggattgcactctccggcgtgctgacgatgttgattggttttagcggattaggccatcgcctggcacggttatttacgccgtcggtgatggtcttgtttatgttgatgctgggcgcgcagctgaccactatctttttcaaaggtatgctcgggctgccgtttggcatagccgacccgaattttaaaattcagttaccgccgttcgcgctctcggtggcggtgatgtgcctggtactggcgatgattatcttcctgccgcaacgttttgcccgttatggcctgctggtcggcaccataaccggctggttgttgtggtacttttgctttccttcttcgcactcgctctccggtgagttgcactggcagtggttcccgctcggcagtggcggtgctttgtcgccgggaattattctgacggcggtgattacaggtctggtaaatatcagcaatacctacggtgcgattcggggcacggatgttttttatccgcagcagggcgcagggaatacgcgttatcgtcgtagctttgtggcgaccggatttatgacgctgataaccgtaccgctggcggtaattccattttcaccgtttgtttcatccattggtttattaacccagactggcgattacacgcggcgttcgtttatttatggcagcgttatttgcctgctggtggcgctggttcctgcactcacgcgactgttttgcagtatccctttacccgtgagtagtgcggtcatgctggtttcttatctgcctttactcttttccgcgctggtgtttagccagcaaataacgtttaccgctcgcaatatttatcgactcgcattgccgttatttgtcggcatatttttaatggcattaccgcctgtgtatctgcaagaccttccattaacgcttcgtcctctgctcagtaacggcttattggtcgggattttactggctgttcttatggataaccttattccgtgggaacgcatcgaataatttgttgaaaaaggattgataatgaagattgtcattgcgccagactcttttaaagagagcttaagtgcagaaaaatgttgtcaggcaattaaagccgggttttcgaccctctttcccgatgcgaactatatctgtttgccgatagcggatggcggcgaagggacggtggatgcgatggtcgccgcgacgggcggcaacatcgtgacgcttgaagtctgcgggccgatgggcgaaaaagtgaatgctttttatggccttaccggcgacgggaaaacggcggtgattgagatggcggcagcaagtggcctgatgctggtcgcgcctgaaaagcgtaatccgttgctggcctccagttttggtacgggggagttaattcgtcatgcgctggataacgacattcgccatattattctcggcattggcggcagtgcgacggtcgacggcggtatgggcatggcgcaggcgctcggtgtgcgtttccttgatgccgacggtcaggcgctggcggcaaacggtggtaatttagcgcgcgtggcaagcattgagatggatgaatgcgatccgcgtctggcgaattgccatattgaagtagcatgtgacgttgataacccgctggtaggggcacgcggcgcggcggcggtgtttggcccgcaaaaaggggcaacgccggagatggtcgaagaacttgaacaggggctgcaaaattacgcccgtgttttacaacagcaaactgaaattaatgtctgccagatggcgggcggcggcgctgcgggcggtatgggtattgcggcggcggtatttctcaatgcggatattaaaccgggcattgaaattgtgttgaatgcggtcaatcttgcgcaggcagtgcagggcgcagcactggtgattaccggggaagggcgcatcgactcgcaaacggcaggcggtaaagcgccgctgggtgtggcgtcggtggcgaagcagtttaatgtaccggtgattgggattgctggcgtattgggtgatggcgtggaagtggtgcaccagtacggcattgacgcggtattcagcattttgcctcgtctggcacctttagccgaagtgctcgccagcggtgaaaccaatctcttcaacagcgcgcgaaatattgcctgcgccattaaaataggtcagggaattaaaaactaacccttacctttaaagcggatgcgatttatatcgcataagagtgcagtactcatgccggatgcggcatgagtaccatatccttcctgaaaatcgcgcaaattctatatattgcagagatcatgtaggcctgataagcgaagcgcatcaggcaatgttacaaaaaaagccacggtataaaccgtggcaaaatccaacatagctaaaaataatcaggcgagtggtatgacttaaatctctacgtcgcggttacaatctttcgagtaaatatagctgaacgcttcaccacgccctacaccataaccagcctgtaaagaataagcgcccataaagatgtaatcgccttttttcaccgggatccagttattgtcgaggttataaaccccctgaccggaaagaatataggcaccgtgttcctgaacgtgtgtttcgatataaccgtggctggcacctggtgcaaaagagaggatatgcatgttcatatcaaaacctaactctttgggcagaaaatccagcagaataacatcgtccatgccttcataatgaatgcgttccagttcgctggcattgccagaaaccagccacggtgcatagccttctaccggaacatagcggcgcttatataaaaagatttggctgtcttcggcctgggcgttaacaaacgtcattaaggagcctggcgggcaataaagatagccaccttcgcttaaggcaaatgttttgccttcggctttggcagtgatatttccagagatcacatacaggaacgtttcaatgccttcgccaccgaagccctgttggttgccaccgttttgatgcagtgtgaccagataatcaacaaaagaggcacccagctttggcgtggagaggattgtcgcgtcacaattttcaaagcccggaataatattttttaccagaccatccggggttaacagtgcgaaattaccgtgtttaacaatcgcacggttagccagtaaatcttcgcggtaaccggtgacgttatttaaatatcccatttatgactccttatttctgccaggcaagttgataaagcatgagtgccaacgttttgaccccttcggcaaggtcggtaatattggtgcgttccgccgggttatggctgatcccgttgatgctggggataaaaatcatgcaggttggtacgcgaggcgcgaaaatttgcgcgtcgtgcccggcaccactgtgcatcacccggtaattcagtttttctctttcacacaattctgtcagggtggcgaccagctccttattcatcggcacgggttcttcgtccatccataaatcgatatcaataccaatgtccatttcatcgcaaatcgcccgcatgtcgttttctaactgttgggtgaaatcgcgcagcacggcagcgtcggtatgacgacaatcaatggtgaacgtggttttacccggcaccacatttaccgtattcgggcgcggctctactttgccaaaggtcagaaccagcggatcgcccatccttttcgctttttcgaccgactgatggcaaatgcgactgaaagcgtaaactgtatcacgacgataacccatcggcgtggtgcctgcatggtttgattcgccgttcagcgttaccgtataacgacgctgcccgacaattgcattcaccacgccaattgattgcccattactttccagcacacagccctgttcaatatgcagttcaacaaaggctttaatatcctgacgcggagttagtggggcgttcggaagagtaaatccgcaagccttcatcgcatcgacaaaactatttcctttggcatcacagatattccgcacgtcgtcaggattcgccagcccaaaaatatttttactgccccagaagacatacgggaagcggctgccttcttcttctgccatcgccaccacttcgaccgtacgtagcggcgcgccgtattgcgttttcagccagtcaattgccagccacgccgccagcgcgccgaattgcccgtcaaggttaccgccgttaaccacggtatcgatatgcgaaccgctcagaaccacttcctgtggatattcggtgccattcaggcgaccgtataaattccccacttcatcgaaacgtgtttccagcccgcttgctgccattctttttttaaattgctgctgggtttccagccattccggcgaataaagtaaacgggtcatcccacccgctgggtcagcgccaaaagaggaaagccagggcagcgtttcttctatagcttgacggaaatgtgtaatcataagaaagtcctgtctcaataattattgcgcaaagggatttttcgtttcgtatgacgtgttataaagcgcgtcggaaattaaatactggtaaatatcatcaacaatttcgatgccttcgacggcggctttgcgttgtttaatatcctgatcctgtccgggataataaacctgattaaaaccgggcgcgggggtaatggcatttaattcgcgcatggtctggctaagatgttgacggaataattcgctggaggagaaaaagttcggattaataactatatgtaattgccccaaattacgccctgcgtgtaaatcgtcatacatcgaactaacctgtcgcccgaacggtaagccgagtaagacgcctgagaggacgtcaatcatcatcatcaggccatacccttttggcccggcggcggggagcagagcatgtaccgcgaacggatcggttgttggtacaccgtttttatcgaccgcccaggtatccgggatagacatattacgcgagcgggcgtcgagcacttttccccatgcctgtacggtagtcgccatatcaaaggtaaggatctcgtcgccttctcccggcgcggcaaaggccagggggttagtaccgtagtaaatttccgcgccgccaaacggcaccaccattggatcggactggcacatcgaaatgccaatgaatccggcgcgggctgcctgctgcacaaaataagagattgcgccgctgtgacccatccggctgataccgaccaccgcaacgccattttgctgggcggttttgatggcatgttccatacccattttcgccgcgacctgtccggcggcattgtcggcatgtaaaattgccgagcacggcccggtttcctcaagacgaaactccggttcgcggttggtgccgccttttgaaatgcgttccgcgtagtattccacgcgcaccgcgccatgagagtggatccctctggcatcggcgtaaaccaatacttcagccacggttgcagcgtgctcacgttttaacccagcctggcagagtttattctcaattagctggtggagtgtttcccgactgattttcatctgtcttcctttttaacgacggtgtgaagcatgactgcaattaacatacagggaaaatatctggattatgtgatccagacaggcaaaaaaatatagttagaatttatttgataatccgctcacttttaacctgatttttaaaacaacaacgcttattaaaaaataatgagtaatagcctggtggttatttgaattcttttgttaataattcctgtgtgatattcatcaccttatttactcgttgtcatcgataccgtaatcgccacattaacactgctcgtgcaattgccatgggtgcaatttttaaggagttgttatgatccacgcctttattaaaaaagggtgttttcaggattcggtcagtttaatgattatttcacgaaaactcagcgaatcagaaaatgttgatgatgtttccgtaatgatgggtacgcccgccaataaagcgttattagataccacaggtttctggcatgacgattttaataacgccacgccgaacgatatttgcgtggcaattcgtagcgaagcggcggatgcggggatcgcgcaggcgattatgcagcagcttgaagaggcgctaaaacaactggcgcaggggtcaggcagcagccaggcgttgacgcaggtgcgtcgctgggacagtgcctgtcagaaattacccgatgccaatctggcgctgatttcagtggctggcgagtatgcggcggagctggcaaaccaggcgctggatcgcaacctcaacgtgatgatgttctccgataacgtcacgctggaagatgaaatccaacttaaaacccgcgcgcgggaaaaaggcttgctggtgatggggccggactgcggtacgtcgatgattgccggcacaccgctggcttttgctaacgtgatgccggaaggcaatattggcgtcattggcgcttccggtaccgggattcaggagctgtgttcgcagattgcgctggcaggggagggaattactcacgcgattggccttggcgggcgcgacctcagccgtgaagtgggcggcatcagtgcgctaacagcgctggaaatgctcagtgcagacgagaaaagcgaagtgctggcatttgtttcaaaaccacctgccgaagctgtgcgtctgaaaattgttaatgccatgaaagcaaccggcaaaccgacggtggcgctgtttttaggttataccccggcggtggcccgcgacgagaatgtctggtttgcctcctcgctggatgaggccgcacgcctggcttgcctgctttcacgcgtcacggcgcgacgtaacgcaatagcgcctgtcagcagcggatttatttgcggtttgtataccggcggtacgctggctgccgaagcggcgggattacttgccggacaccttggcgtggaagccgacgatacccatcaacatggcatgatgctggacgccgatagccaccagattattgacctcggcgatgatttctacaccgtcgggcgtccccatccgatgatcgacccaaccttacgcaaccagttaattgccgatctcggcgctaaaccgcaagtgcgcgtgttgctgcttgatgtcgtgattggcttcggtgcgaccgccgatcctgccgcctcgctggtgagcgcctggcaaaaagcctgtgccgcgcgtttagataatcaaccactgtatgccattgccacggtgacaggcactgaacgtgacccgcaatgccgctcgcagcaaatcgccacgctggaagatgcggggattgcggtcgtgagttcgctaccggaagccaccttgctggcggcagcgttaattcatccgctctcgcctgccgcacagcaacacacaccgtcattactggaaaacgtcgccgtgattaacatcggattacgcagctttgcgctggagctacaaagcgccagcaaaccggttgtgcattaccaatggtcgccagtcgccggtggcaataaaaaactggctcgtttattagaacgtttgcaataaggggttcccatgtttacatcagtggcgcaagccaatgctgcggttatcgaacaaattcgtcgcgctcgtccacactggctggatgtgcaaccggcttcttcacttatcagcgaactaaacgaaggcaaaacactgcttcacgccgggccgccaatgcgctggcaggagatgaccggacccatgaaaggggcgtgcgtgggcgcatgtctgttcgaaggttgggcgaaagatgaagcgcaggcgctggcaatactggagcaggggaagtgaacttcattccttgtcaccatgtgaatgccgtcgggccaatgggcggtattacttctgccagtatgccgatgctggtggttgagaacgtgaccgacggcaaccgggcgtactgcaacctcaacgaaggtatcggcaaagtgatgcgttttggcgcttacggcgaagatgtcctgactcgccatcgctggatgcgcgatgtgttaatgccagtattaagcgcggcgctggggcgcatggagcgcggtatcgatctcacggcgatgatggcgcagggcattacgatgggcgatgagttccatcaacgcaatattgcttcctctgcactgttaatgcgtgcgctggccccacaaattgctcgcctcgatcatgataaacagcacatcgccgaagtgatggatttcctcagcgtgaccgatcagttcttcctcaacctcgcgatggcttactgcaaggcggcgatggatgctggcgcgatgatccgcgcaggcagcatcgtcacggcaatgacccgcaacggcaatatgttcgggattcgggtaagcgggctgggcgaacgctggtttactgcgcctgtaaacactccgcaaggtctgtttttcaccggcttctcgcaggagcaggcgaacccggatatgggcgatagcgcgattaccgaaacctttggtatcggaggtgcggcaatgatcgcagcgcctggcgtaacgcgctttgtcggtgcgggtggcatggaagcggcaagagcggtatctgaagagatggcggaaatttaccttgaacgcaatatgcagttgcagatcccaagctgggattttcagggcgcgtgcctggggctggacattcgtcgcgtggtagaaaccggcattacgccactcatcaataccggtatcgcccataaagaggcggggatcgggcagattggcgcaggcaccgtgcgggcaccgctggcgtgctttgaacaggcgctggaagcactggctgaaagcatgggtattggttgaggaacgcgcaatgacgatcatccatcctctgcttgccagtagtagcgcaccgaattatcgccagtcctggcggttagcgggagtgtggcggcgggcgattaacctgatgacggaaagcggcgaactgttaacgttgcatcgtcagggtagtggtttcggccccggaggatgggtgcttcgccgtgcgcaattcgatgcgttatgcggtggattatgcggcaatgaacgaccacaggttgtggctcaagggattcgcctcgggcgtttcacggttaaacagccacagcgttattgtttgctgcgtattacgccgcctgcgcatcctcaaccacttgcagctgcatggatgcaacgcgcggaggaaaccgggcttttcgggccactggcgttggcggcaagcgatccgctgcctgctgagttacgccagtttcgtcactgttttcaggccgcgctcaatggcgttaagaccgactggcggcactggctgggtaaaggccccggattaacgccgagtcatgatgacacgctgagcggaatgctgctggcggcctggtattatggcgctttagatgcgcgctccggtcgtccgttttttgcctgttccgacaatctgcaactcgttaccacagcggtgagcgtcagttatttacgttatgccgcgcaaggatatttcgcctcgccactcctgcactttgttcatgctctgagttgcccgaaacgtaccgctgttgcgattgattcgctgctggcgctggggcatacgtcaggggcagatacgctgctggggttctggcttggccaacaattattacaaggaaaaccatgaaaacactggttgtggctcttgggggcaacgccttactccagcgcggtgaggcgctgacggcagaaaatcaatatcgcaatatcgccagtgctgtacccgcgctggcacgcctggcccgttcttatcggttggcgattgttcacggcaacgggccgcaggtggggctgctggcattgcagaatctggcgtggaaagaggtagaaccgtatccgctggatgtgctggttgcggaaagccaggggatgattggctatatgctggcgcagagtttgagcgcacagccgcagatgccgcccgtgacgacggtgctgacgcgcattgaggtttcgcctgatgatccggcgtttttgcagccagagaaatttattggtccggtttatcagccagaagaacaagaggcactggaagcggcttacggctggcagatgaaacgtgatggtaaatatttgcgccgggtggtggcgtctccgcaaccgcgtaaaattctcgacagcgaagccatcgagttgttgctcaaagaggggcatgtggtgatttgcagtggcggcggcggtgtgcctgtgacggatgacggagcagggagtgaagcagtgattgataaagatctcgccgctgcgttgctcgccgagcagattaatgcagatggactggtgatcctcaccgatgctgatgcggtatatgaaaactggggaacgccgcagcaacgtgccattcgccatgccacaccggatgagttagcgccatttgccaaagccgatggttcgatggggccgaatgtaacggcggtgagtggttatgtcagaagccgtggtaaacccgcgtggattggggcgttatcgcgaattgaagagacgctggcgggcgaagcggggacctgtatttcgctgtagtcgtaggcattagacatttgtgcctgatgcgacgcttgacgcgtcttatcaggcctacaaccggtgccgcatccggcaattggtgcacaatgcctgatgcgatgcttgacgcatcttatcaggcctacaatgggtaccggatcggtaggccggataaggcgtttacgccgcatccggcaagaatagagcaccagttaaccgaacttactctgcgcccaaatcacgccgctggcatattccggcggcagcagcgggattaaggcttccagcgtcgcagtcagacgcgatgtgtcgctgtcggtcaaattcagatgccccactttacgccccggacggacttctttgtcgtaccagtgcagatgcaccagcggcagtttcagccagtcataattcacatcgctaccaatcagattgatcatcaccgacggattattcaccactggttgcggtaacggcagatcggtaatcgcccgcagatgcagctcaaactggctgatgctggcaccgttttgtgtccagtgaccgctgttatgcacacgcggtgccagttcgttgatcaacagaccttgcggggtgacaaaacactccatcgccatcacgcccacatagcccagctcctgcataatcgccgacagcatctcttcggcttgcgcctgctgctgtgcgttggcctgcggaaaagcgacgctggtgcgcaaaataccgtcctgatgcaggttatgcgtcagcggataaaacacggtgctgccatcaaagccgcgcgcgccaaccagcgacacttcaccagagaagttaatgccctgctcgacaatacattcgccgtaacactctgccggtaactgttcggtttcatttgcgcgtaaacgccattgaccgcgaccgtcataaccaccagtgcgacgcttaacaatcgccagctcacctaaacgatcaaacaccgcaggccactcgctgcgttcggcaagtaactgccacggtgcagtcggcaggtggagcttatcgaaaagctgcttctgagtcagacggtcagcaataatcgggaacacatcgcggttcacaaaggccggatggcgcgccagctcgcgggttaatgcggtttccggccagcgttctatctcagcggtaatcacgctttgttgaaaaggcaccgccgccggttcagcgtccagcccgactggccagacagcaatgcctaacggttcgcctgcctgacgcagcatacggcctaactgcccgttaccgaggacgcaaacctgtttcatgccgcacctcgcgggtccgggttttccagcacttcgtcggtctgggctttgcgccagtcattcagacgctggtgcagttctttatcatgagtcgcaagaatttgtgctgccagtaacgccgcgtttgccgcgccagctttaccaatcgccagcgtacccaccggaatgccgcgcggcatttgtacgatggagtagaggctatcgacaccgctcagtgcggcgctctgtactggcacgcccagcaccggcaccagcgttttggcggcaatcatgcctggcagatgcgctgcgccgcctgcgcccgcaataatcacctgataaccgttctcttcggcgctttcggcgaagctgaacagtttatcgggggtgcggtgagcagaaaccacttcaacgtggtgcgggacattcaggatttcgaagatttcggcggcgaactgcatggtagcccagtcgcttttggaccccatcacgatggcgacacgcgccggattattgcgggaagacatgcgtcttaaaactcctgtggtgcacaactctcggctttagagggcacagagaatagcacggaaagagagcaaggaaaacggttgcgtggctgtgaaatcagcaaagttgcgggttttttaaaacggaaaatgaatcagctcaacgtcatccgccgtgactttcaccattgaaccttccgtatgccaggcacccagtaccacgcgaaaagcaggttgctgattggcgataagttcatgcaccgccgggcgatgggtatgcccgtggatcagccattgcacctgatgtttttccatcgcactgaccaccgcgttttggttaacgtccatgatcgccagcgatttactgctgttggcttctttgctgttcgcgcgcattcgcgcggcaatgcgtttgcgcacaaacaacggcagggcgaggaatagcgtctgcagccagggtttgtggaccttggcgcgaaaagcctgataacccgcgtcatcggtgcacagcgtgtcgccatgcataatcaacacccggcgaccataaagttcgagcaccttttcttccggcaataacgtcatgccactttcacgggcaaagcgtttgccgagcagaaaatcacggttgccatgaatgaaataacagggaacgccggaatcggacaccgctttgatcgccgccgccatcttgcgatggagtgggttgggatcgtcgtcgccaatccatgcttcaaacagatcgccaagaatatacagcgcgtcggccttgcgggcttcccccgctaaaaaacgcagaaaaccggcggtgatcgccggttcttccacgcagagatgaagatctgcaataaagagtgtcgccacgattactcgctaacggtcacgctttcaatgataacgtcttcttttggcacgtcctggtgcataccgctacgaccggttgcaacacctttgattttgtctaccacgtccatgccgtcaaccacttcagcaaacacgcagtagccccaaccttgcaggctttcgccagagaagttcaggaagtcgttatcaaccacgttgatgaagaactgtgcagttgcagagtgcggagcctgagtacgtgccattgccagcgtaccacgggtatttttcaggccgttgttggcttcgtttttgatcggttctttggtggctttttgtttcatgcccggttcaaaaccgccgccctgaatcataaagccgttgataacacggtggaaaatggtgttgttgtaaaaaccttcgcggcagtagtccaggaagtttttaactgtttcaggtgctttatcgtcaaaagttttgatgacaatatcgccgtgattggtgtggaaagtaaccatttttgcatcctgttccgtttgattggtgcttcaacccagttcgggtcatatatagggtggtgttatagcataaccgcacgatcggatcatcacgcaatgtatgctgattcgcgcgggaaatatgggtattatacgcaactcaattacccacacatgtctaaacggaatcttcgatgctaaaaatcttcaatactctgacacgccaaaaagaggaatttaagcctattcacgccggggaagtcggcatgtacgtgtgtggaatcaccgtttacgatctctgtcatatcggtcacgggcgtacctttgttgcttttgacgtggttgcgcgctatctgcgtttcctcggctataaactgaagtatgtgcgcaacattaccgatatcgacgacaaaatcatcaaacgcgccaatgaaaatggcgaaagctttgtggcgatggtggatcgcatgatcgccgaaatgcacaaagattttgatgctttgaacattctgcgcccggatatggagccgcgcgcgacgcaccatatcgcagaaattattgaactcactgaacaactgatcgccaaaggtcacgcttatgtggcggacaacggcgacgtgatgttcgacgtcccgaccgatccaacttatggcgtgctgtcgcgtcaggatctcgaccagctgcaggcaggcgcgcgcgttgacgtggtcgacgacaaacgcaacccaatggacttcgttctgtggaagatgtcgaaagagggcgaaccgagctggccgtctccgtggggcgcgggtcgtcctggctggcacattgaatgttcggcaatgaactgcaagcagctgggtaaccactttgatatccacggcggcggttcagacctgatgttcccgcaccacgaaaacgaaatcgcgcagtccacctgtgcccatgatggtcagtatgtgaactactggatgcactcggggatggtgatggttgaccgcgagaagatgtccaaatcgctgggtaacttctttaccgtgcgcgatgtgctgaaatactacgacgcggaaaccgtgcgttacttcctgatgtcgggccactatcgcagccagttgaactacagcgaagagaacctgaagcaggcgcgtgcggcgctggagcgtctctacactgcgctgcgcggcacagataaaaccgttgcgcctgccggtggcgaagcgtttgaagcgcgctttattgaagcgatggacgacgatttcaacaccccggaagcctattccgtactgtttgatatggcgcgtgaagtaaaccgtctgaaagcagaagatatggcagcggcgaatgcaatggcatctcacctgcgtaaactttccgctgtattgggcctgctggagcaagaaccggaagcgttcctgcaaagcggcgcgcaggcagacgacagcgaagtggctgagattgaagcgttaattcaacagcgtctggatgcccgtaaagcgaaagactgggcggcggcggatgcggcgcgtgatcgtcttaacgagatggggatcgtgctggaagatggcccgcaagggaccacctggcgtcgtaagtaattgcgctattgccggatgcgagttttcgcatccggttatcgtctgcgccaccacaacattcccatcagtagcatccccggcaaccacacccacatcaattcagaaataatcacctgatgcccgtacggcgtggtgtaacgagacaatgcaaacggcgcgacttttatcacctgccagggagcgaaaaagcgttcatctgaccacggccacagccagccaacgcctttaccgccagtggttaccgaatccagcaagctgtgcgatagcaacgagacggttaaaaacagccagcagcgaatcagcccagccctgaaccatcggcgtccaataaacacacataacagcgggacaacaaacgcaaacaccagcgaatgggtaaacccgcgatgaccaaaaacattgccgtaagcaacgccaaatttaaacgacaatacgtcggcgtcgggcagcatcgccaggatgattccggcaaataacagacgcggagggatgactttcgaacccaaccctaaaccaatgcataggggaacggcggcgtgcgtaataacggttggcatgatggtcgcttcggcaaaatgtcgatgctatcagcatggatgaacggggcgtagagggcaaaagtctgaaaagagaaccggcctgttgatacaggccgggaaagggatcaggcaacaacctgtacgctgtgacctgcaaaactcactgtctgaccggcgacgattttgcagcgtttgcgcgtttcaaccgcaccgtcgactttcacctggccttcggcaatcgcgattttcgcctgcgcgccgctttcgctccagccttccagtttcagcaagtcgcacagctcaacgtgcggatgtttacctaaagaaaatgtcgccatgttactcatcctgtggatcatgatattcaacgcacgcctgtagcgtgttttcaatcagcgtggcaaccgtcatcgggccaacgccgccgggaacaggcgtaatgtatgaggcgcgtttagccgcgtcttcaaacacgacgtcgcccacaactttgccattttccagacggttgatgccgacatcaatcacaattgcgccttctttgatccagtcaccgggaataaagcctggcttgccaacggcaacgatcaatagatcggcattttctacgtgatgacgcagatttttagtgaagcggtgagtcactgtagtggtgcaacctgccagcagcagttccatgctcatcgggcggccaacgatattcgatgcgccaatcaccacggcgttgaggccgaaggtatcaatgttgtaacgctcaagcagcgtgacgataccgcgcggggtgcagggacgcagacgcggcgcgcgctggcacagacgaccgacgttgtaaggatggaaaccgtccacgtctttgtccggatgaatacgttccagcactttgacgttatcaatacccgccggtaacggcagttgaaccagaatgccatcgatggtgttgtcggcattcagcgtatcgataagctccagcagctccgcttcgctggtggtttccgggaggtcataagagcgggagacgaacccgacttcttcacaagccttgcgtttgcttgcgacataaatttgcgatgcagggttactacccaccagcacaacggccagtcctggtgcccgcagtccggctgcaatacgcgcctgaactttttgagcaacttcagagcgcacctgctgcgcaatcgttttaccgtcaataatctttgctgccatcagagagaggattccatctgttacgtagatcgaaggggatgcgcctattttgtcagaagcggggcgcgctgtcaggtttcgtttcagatttatcgcgtgaagcgacctcttgcgaaggtgaggcgcaccgtcgctgagactgaaagcttcatttttcgtccatgatggcgttgtaaatctggaactgatttatttccttgtctaaggattaagataatttaagaaatacctgacaatataaaaagaattttcagcctggtaatttaccgcttcaggtctatatttgtgttgaatatattttgcgcggaagtattcatctaacggggctctctattttttagaatagagtgcatattttcaattaagacattcttagaggataaaaaggaatttactactatcagtgtcttaaataaagtaatcggttatatacggatgtggagtcgataaatgagattgaaggaatatatatgaaattaagatttatttcgtctgcgctggctgccgcactattcgccgctacgggtagttatgctgccgttgtagatggcggtacaattcactttgaaggcgaactggtgaatgctgcctgttcagtgaatactgactcggcagaccaggttgtcacactcggtcaatatcgtaccgatattttcaatgctgttggtaatacctctgcattaattccattcaccattcagttgaacgactgcgatcctgttgttgccgctaatgctgccgttgcattttctggtcaggctgatgcaatcaatgataatttattggccattgcatccagtaccaatacaacaacagcaacgggtgtcggtattgaaatacttgataatacatccgcaattctcaaacctgatgggaatagcttctcaaccaaccagaacttgatccccgggaccaacgttcttcatttttctgcacgttataaaggcaccggtacaagtgcatcagcagggcaagcaaatgctgacgcgacttttattatgagatatgaataatcaaaaccacgttgttttgaattatatatcacgtcttataacaaagtaatgtaccggttgtctgaagcggtatggtggcaatgtaaatcgaaatcatgttcactttgtatcatgccgctttattaaatgaaaagggaatgatgtgttgtaagaaaccaaagcaatcatttctttatattccttatttttgccgtcaggaatacacaaggcgtattaactatgatgactaaaataaagttattgatgctcattatattttatttaatcatttcggccagcgcccatgctgccggagggatcgcattaggtgccacgcgtattatttatcccgctgatgctaaacagactgcggtatggattagaaatagccataccaatgagcgctttctggtcaattcgtggattgaaaacagcagcggtgtaaaagaaaagtcattcatcattacaccgccactgtttgttagtgaacccaaaagcgaaaatactttgcgtattatttacaccggtccaccgctggcagcagatcgtgagtctctgttctggatgaatgttaagacgatcccttcggtagataaaaatgcattgaacggcaggaatgttttgcaactggcgattttatcgcgcatgaaattatttctccgtccaattcaattacaagaattacccgcagaagcgccggacacactcaagttttcgcgatccggtaactatatcaatgttcataatccatcacctttttatgtcaccctggttaacttacaagtgggcagccaaaagttggggaatgctatggctgcacccagagttaattcacaaattcccttaccctcaggagtgcagggaaagctgaaatttcagaccgttaatgattatggttcagtaactccggtcagagaagtgaacttaaactaaccgaatcatctgacaatatcagagctaattatgaaaatacccactactacggatattccgcagaggtatacctggtgtctggccggaatttgttattcatctcttgccattttaccctcctttttaagctatgcggaaagttatttcaacccggcatttttattagagaatggcacatccgttgctgatttatcgcgctttgagagaggtaatcatcaacctgcgggcgtgtatcgggtggatctctggcgtaatgatgagttcattggttcgcaggatatcgtatttgaatcgacaacagaaaatacaggtgataaatcaggtgggttaatgccctgttttaaccaggtacttcttgaacgaattggccttaatagcagtgcatttcccgagttagcccagcagcaaaacaataaatgcatcaatttactgaaagctgtacctgatgccacaattaactttgattttgcagcgatgcgcctgaacatcactattcctcagatagcgttgttgagtagcgctcacggttacattccgcctgaagagtgggatgaaggtattcctgctttactcctgaattataatttcaccggtaacagaggtaatggtaacgatagctatttttttagtgagctcagcgggattaatattggcccgtggcgtttacgcaacaatggttcctggaactattttcgcggaaatggatatcattcagaacagtggaataatattggcacctgggtacagcgcgccattattccgctgaaaagtgaactggtaatgggagacggcaatacaggaagtgatattttcgatggcgttggatttcgtggtgtacggctttattcttctgataatatgtatcctgatagccagcaagggtttgccccaacggtacgtgggattgcccgtacggcggcccagctaacgattcggcaaaatggttttattatctatcaaagctatgtttcccccggcgcttttgaaattacagatttgcacccgacatcttcaaatggcgatctggacgtcaccatcgacgagcgcgatggcaatcagcagaattacacaattccgtattcaacagtgccaattttacaacgcgaagggcgtttcaaatttgacctgacggcgggcgattttcgtagcggtaatagtcagcaatcatcgcctttcttttttcagggtacggcactcggcggtttaccacaggaatttactgcctacggcgggacgcaattatctgccaattacaccgcctttttattagggctggggcgcaatctcgggaactggggcgcagtgtcgctggatgtaacgcatgcgcgcagtcagttagccgacgccagtcgtcatgagggggattctattcgcttcctctatgcgaaatcgatgaacaccttcggcaccaattttcagttaatgggttaccgctattcgacacaaggtttttatacccttgatgatgttgcgtatcgtcgaatggaggggtacgaatatgattacgacggtgagcatcgcgatgaaccgataatcgtgaattaccacaatttacgctttagccgtaaagaccgtttgcagttaaatgtttcacaatcacttaatgactttggctcgctttatatttctggtacccatcaaaaatactggaatacttcggattcagatacgtggtatcaggtggggtataccagcagctgggttggcatcagttattcgctctcattttcgtggaatgaatctgtagggatccccgataacgaacgtattgtcggacttaatgtttcagtgcctttcaatgttttgaccaaacgtcgctacacccgggaaaatgcgctcgaccgcgcttatgcctcctttaacgccaaccgtaacagcaacgggcaaaatagctggctggcaggtgtaggtgggaccttactggaaggccacaacctgagttatcacgtaagccagggtgatacctcgaataatgggtacacgggcagcgccacggcaaactggcaggccgcttacggtacgctggggggcgggtataactacgaccgcgatcaacatgacgttaactggcagctgtctggcggtgtggtcgggcatgaaaatggcataacgctgagccagcctttaggggataccaatgttttgattaaagcgcctggcgcaggcggtgtacgcattgaaaatcaaactggcattttaaccgactggcgcggctatgcggtgatgctgtatgccacggtttatcggtataaccgtatcgcgcttgataccaatacgatggggaattccatcgatgttgaaaaaaatattagcagcgttgtgccgacgcaaggcgcgttggttcgtgccaattttgatacccgcataggcgtgcgggcgctcattaccgttacccagggcggaaaaccggtgccgtttggatcactggtacgggaaaacagtaccggaataaccagtatggtgggtgatgacgggcaagtttatttaagtggtgcgccattgtctggtgaattactggttcagtggggagacggcgcgaactcacgctgcattgcgcactatgtattgccgaagcaaagcttacagcaagccgtcactgttatttcggcagtttgcacacatcctggctcataaaggaaattatcaataagataatctgcagattattattggcgatggcatgtttgtgtctggcaaacatatcctgggctactgtttgtgcaaatagtactggcgtagcagaagatgaacactatgatctctcaaatatctttaatagcaccaataaccagccagggcagattgttgttttaccggaaaaatccggctgggtaggtgtctcagcaatttgtccacccggtacgctggtgaattatacataccgtagttatgtcaccaactttattgttcaggaaactatcgataattataaatatatgcaattacatgattatctattaggtgcgatgagtctggttgatagtgtgatggatattcagttccccccgcaaaattatattcggatgggaacagatcctaacgtttcgcaaaaccttccattcggggtgatggattctcgtttaatatttcgtttaaaggttattcgtccctttattaacatggtggagatccccagacaggtgatgtttaccgtgtatgtgacatcaacgccttacgatccgttggttacacctgtttataccattagttttggtggccgggttgaagtaccgcaaaactgcgaattaaatgccgggcagattgttgaatttgattttggtgatatcggcgcatcgttatttagtgcggcagggccgggtaatcgacctgctggtgtcatgccgcaaaccaagagcattgcggtcaaatgtacgaatgttgctgcgcaggcttatttaacaatgcgtctggaagccagtgccgtttctggtcaggcgatggtgtcggacaatcaggatttaggttttattgtcgccgatcagaacgatacgccgatcacgcctaacgatctcaatagcgttattcctttccgtctggatgcagctgcggcagccaatgtcacacttcgcgcctggcctatcagtattaccggtcaaaaaccgaccgaagggccgtttagcgcgctggggtatttacgcgtcgattatcaatgaggtacggagaatgagaagagtactctttagctgtttctgcgggctactgtggagttccagtggatgggcagttgaccctttaggaacgattaatatcaatttgcacggtaacgttgttgatttctcctgtaccgtaaacacagcggatattgataagacggtagatttaggcagatggcctacgacacaactactgaacgctggcgataccacggcactcgtcccttttagcctgcggctggagggatgtcctccgggttcagttgcgattttatttacgggaacgccggcatccgataccaacctgctggctctggatgatcccgcaatggcacaaaccgtcgccatcgaattacgtaatagcgatcgctcccggctcgcactgggggaggcgagcccgactgaggaagtagatgcaaatggcaatgtcacactaaacttttttgccaattatcgagcgttagccagcggtgttcggccaggtgtggcgaaagcggatgcgatatttatgatcaattataattaatattatattaattcgtataatttggcgtagtcgataagctctacaattgaatgcaaacctagcttgccataaatattagatttatgcgcactaactgttttattgctaagtaataacttatcggcaatttctttattagataatccgctaaccagataacgtaatatggtcacttcacgattagatagcacagtgaccgttgaactattcgtactacatttattgctttttatatagttaagcgtttcgctgggaaaaaacgtgtatccggagaggatcatctgaacggcatgaaaaatatcattctgatcattgcatttactgacaaaaccgttagcaccagcttgtatcgctctgccagcataaaagcattctgatttcgatgataaaaataacactttcactgtgctctggatttgtttgatccttttcaggaaggtaaaaccgtctgttccgggcaagtctatatccataatgattaaatcaacaggacgggttcggagataatcgatggttatgcgataatcatccgttttcaggacaatctgcaattcactgtttttttgcaacagaacttcaatagacattctgatgataggatgagtatccataatgatcaccgacgttggtttcatagttaccagtctcataggagcggacaattttccgttaggtcgggaaattgtactttgatacatgaaaatacgggttttcttgattcagacgcgcagcggtgtgcgtttgtttgccgctatagcgaaataaatcagaaaatcagacgcggtcgttcacttgttcagcaaccagatcaaaagccattgactcagcaagggttgaccgtataattcacgcgattacaccgcattgcggtatcaacgcgcccttagctcagttggatagagcaacgaccttctaagtcgtgggccgcaggttcgaatcctgcagggcgcgccattacaattcaatcagttacgccttctttatatcctccataatttcagagtgggacatatttgggacattatcaccaaaaatgtcgtctattttcctcgcatgctctgtcaaatgattaggcgcaaggtgagcatacctacgaaccatttctatggactcccatccgcccatttcctgaagcactgataatgggacgcctgactgaatcagccagcttgcccaggtgtgtctgaggtcatggaaacggaaatcttcaattcctgcacgacgacaagctgatagccatgatgtcttgctgtcgatgcgcatcttcctgaccgcaggcgttgatgttccatctgctcgcttagccgccttggtatgtacaaacacccatttgtgatgcttgcctatttgatcacgcaacactttacaggcggtatcgttcagcgccacaccaatggcgcggtttgatttgctctcttctggattcacccaggcaactcgtcgctgcatgtcgatttgttgccattccagatttatgatgttcgactttctcagaccagttgccagcgcaaacttgacgacagatttcagtggttcggggcactcatcaataaggcgttttgcttcctccttttccagccatctgactcgcttgtttctgaccgctggtatcttgatgacaggcgctttttccagccacttccagtcgcgttctgcagcacggagaatggcctttatcatggcaagatgctttgcctttgtctgagttgatactggctttggttcataaacaggcagttctttacctttcctgatggcggcctgaactttctgtttccatatttctttcgtctttctgttatgcattctgcttacagcagagtaaatctttgcctccgagatatctttaagccttataccctcaaaatgttcaagccagaactcaatccggcttttatctgaatcgagagattttttatcagctttttcctcaagccatcttaggcaggcctcttcaaaagtgacatcaggtaaatcccctagcttttctactcgccagagttctgcttttcgcttgtcgtgcaactcctgagcttgccgtttgtcctttgtgccaagagattccttaattcgtttcccgcccgggagcgaatacgaggcataccatatttcatttctgcggaagagtgacattttctttcctctgttatgccatcacccgcgctcacctggacagtatgcagcggagactgaagcgccgcaatgcaggcttgccgtgttgtgaggtacccggatattatcgtgaggatgcgtcatcgccattgctccccaaatacaaaaccaatttcagccagtgcctcgtccattttttcgatgaactccggcaccatctcgtcaaaactcgccatgtacttttcattccgctcaatcacgacataatgcaggccttcacgcttcatgcgcgggtcatagttggcaaagtaccaggcatcttttcgcgtcacccacatgctgtactgcacctgggccatgtaagccgattttattgcctcgaaaccaccgagccggaatttcatgaaatcccgggaggtacgagtattgccggaagcgtggcctgtatccggatgcagagtcttatccgtggaaatcgaacgcgcattactggttggttaccaacttgtaccagaacatgcgggccaatgcgctggctgacgcggaattacggcgcaaggctgccgatgaactgacctgtatgacagcgcgaattaaccgtggtgagacgatacctgaaccagtaaaacaacttcctgttatgggcggtagacctctaaatcgtgcacaggctctggcgaagatcgcagaaattaaagctaagttcggactgaaaggagcaagtgtatgacgggcaaagaggcaattattcattacctggggacgcataagagcttctgtgcacaggacgttgccgcggtaacaggcgcaaccgtaatctgatcttacccagcaatagtggacacgcggctaagtgagtaaactctcagtcagaggtgactcacatgacaaaaacagtatcaaccagtaaaaaaccccgtaaacagcattcgcctgaatttcgcagtgaagccctgaagcttgctgaacgcatcggtgttactgccgcagcccgtgaactcagcctgtatgaatcacaactctacaactggcgcagtaaacagcaaaatcagcagacgtcttctgaacgtgaactggagatgtctaccgagattgcacgtctcaaacgccagctggcagaacgggatgaagagctggctatcctccaaaaggccgcgacatacttcgcgaagcgcctgaaatgaagtatgtctttattgaaaaacatcaggctgagttcagcatcaaagcaatgtgccgcgtgctccgggtggcccgcagcggctggtatacgtggtgtcagcggcggacaaggataagcacgcgtcagcagttccgccaacactgcgacagcgttgtcctcgcggcttttacccggtcaaaacagcgttacggtgccccacgcctgacggatgaactgcgtgctcagggttacccctttaacgtaaaaaccgtggcggcaagcctgcgccgtcagggactgagggcaaaggcctcccggaagttcagcccggtcagctaccgcgcacacggcctgcctgtgtcagaaaatctgttggagcaggatttttacgccagtggcccgaaccagaagtgggcaggagacatcacgtacttacgtacagatgaaggctggctgtatctggcagtggtcattgacctgtggtcacgtgccgttattggctggtcaatgtcgccacgcatgacggcgcaactggcctgcgatgccctgcagatggcgctgtggcggcgtaagaggccccggaacgttatcgttcacacggaccgtggaggccagtactgttcagcagattatcaggcgcaactgaagcggcataatctgcgtggaagtatgagcgcaaaaggttgctgctacgataatgcctgcgtggaaagcttctttcattcgctgaaagtggaatgtatccatggagaacactttatcagccgggaaataatgcgggcaacggtgtttaattatatcgaatgtgattacaatcggtggcggcggcacagttggtgtggcggcctcagtccggaacaatttgaaaacaagaacctcgcttaggcctgtgtccatattacgtgggtaggatcaaccagcataaatcaggctgcggctaaaatggcgcgggcaggaatcctggtcgttgatggtaaggtctggcgaacggtgtattaccggttcgctaccagagaagaatgggaaggaaaggtgagcacgaatctgatttttaaggagtgtcgccagagtgccgcgatgaaacgggtattgagggtatataaaagaacatcaatgggaacacaatgatgaaacaggtgagttgagttcaaactgtagtacaattctctccagtttgaacaggaaagaatatgctatgaacccttatatttatcttggtggtgcaatacttgcagaggtcattggtacaaccttaatgaagttttcagaaggttttacacggttatggccatctgttggtacaattatttgttattgtgcatcattctggttattagctcagacgctggcttatattcctacagggattgcttatgctatctggtcaggagtcggtattgtcctgattagcttactgtcatggggatttttcggccaacggctggacctgccagccattataggcatgatgttgatttgtgccggtgtgttgattattaatttattgtcacgaagcacaccacattaaaataatttgtttctaaacgactaaaatatggaggctcttatatttatatgagcctcgttttatgctttttgttaatgtctttattttttatgtattcttttgtgctttcaagattatggcgtaagaaaattgcaatacgattattgttgtatattcaagataatgtgaccttaattgtctttttaaataaaaaataaacaaaaattatatcccaccactaaggtttataaaagcatacgttagcaggtgtcaccatgaaaaaagccatagcatatatgcgattttcatcaccaggtcagatgtctggcgactcattaaaccgacagagaagacttattgctgaatggttaaaggtaaatagtgattattatcttgataccataacatatgaagatttaggattaagtgcattcaaaggaaagcatgcacaatcaggagctttttcggaatttttagatgctatagagcatggttatatattgccaggaactacattgttagttgaaagtctggacagactttcaagagaaaaagtcggtgaagcgattgaacgtctgaaattgattttgaatcacggtattgatgttataactctttgcgacaatacagtctataatattgactctttgaatgagccatattcattaataaaagccatacttatagcacaaagggcaaatgaagaaagcgagataaagtcaagtcgggttaaattatcatggaagaaaaaacggcaggatgcactggaatcaggtacgattatgacggcgtcttgtccgagatggctctccttagatgacaaaagaacggcttttgttccagaccccgacagggtgaaaactattgagctaatttttaaactcaggatggaaaggcgctcattgaatgcaatagccaagtatttaaatgatcatgctgtaaagaatttctcaggaaaagaaagtgcatggggaccttctgtaattgaaaaattattagcgaataaagctctgataggtatttgcgtaccttcatatcgtgcaagagggaaagggataagtgaaatcgctggctattatcccagagtcatatcagatgatttgttttacgctgtacaggaaattcggttggcaccttttggtattagcaatagtagcaagaatcctatgctaataaatctacttcgaacagttatgaagtgtgaggcttgtggtaataccatgattgttcatgcggtatctggaagtttgcatggctattatgtttgtccgatgagaagattacatcgatgtgacaggccatcaataaaaagagatttggttgattataatatcattaatgaattgctttttaattgtagcaaaattcaaccagttgaaaacaagaaagatgctaatgaaactttagagttaaaaattattgagcttcagatgaaaattaataatttaatcgttgcattgtctgtcgcgcctgaagttaccgctatagcagagaaaataagactattagataaggaattacgaagggcttcggtatcattgaaaactttgaagagtaaaggtgtaaattcattcagtgatttttatgctattgacttaaccagtaaaaatggacgagagttatgccgtacacttgcctataaaacattcgaaaaaatcataattaatacggataataaaacctgtgatatctattttatgaatggcattgtttttaaacactatcctttaatgaaagtaatatccgcccagcaggcgataagtgctctcaaatatatggttgatggtgagatttatttctaaataatgatctcggattttaagttatgctatggtgataaagtgcaagacagaattaattatctttgacgaaacttaatgggtaattactttgtttgctcccacaagcgagttttgtacggctgtattggggtagtaaatgagctatacaatcttaatcatttgttaggtgagaactcttggtcgcagattcaaatactgaaaatacgtgacaaattattatgagcaaaatggtgtatgtcacgtattttgaatggtaggttaaaaaataacaccgactttcgtaggtgttactaataataaagcagagtttttagatagtatcaatgtgctttgtgtatattgtggcaaataattgggttgggggtacaattgtgattgcttttgcatgaacattgcgcctttatgcataatgagataaaggaatatcaaataaaataacgataggtcataacaaagaggtttttatgaaaacacttatcgtttcaactgtattggcattcataacattttctgcgcaggctgcagcatttcaggtcactagtaatgaaataaaaacaggagagcaacttacaacgtctcatgtcttttctggatttgggtgtgaaggtggtaatacatcgccctcattaacctggtctggtgttcctgaaggtaccaaaagctttgccgtaactgtatatgatccagatgcacctacaggcagtggttggtggcattggactgttgttaatattccagcaacagtaacatatttgcccgttgatgcagggagacgtgatggaacaaaactgccgactggtgctgttcaaggccgaaatgattttggctatgctgggtttggtggcgcatgtcctcctaaaggagataaaccacatcattaccagtttaaagtatgggctctaaaaactgaaaagattcctgtagattctaactccagcggagcgttagttggttatatgcttaatgctaataaaatcgcaaccgctgagataacaccagtttatgagataaagtagggtgagagtatgctggcaagaggtaagactaacttaaagatcgaagaaatacggatgcataaacatcatgagattcatagggttaagcctcttatgccagctttgtgtcgtatccgtcagggaaagaaagttatcaattgggagacgcatactttaactgttgataataatcaaataatattatttccttgtggttatgaattttatattgagaattatcctgaagcagggctttatcttgcagaaatgctttacttacccattgatttaattgagagtttccaaaaactttatacggtaactgatcaaatacgtaacaaaacaagtttctttttacctcagaatcctgagttaatatattgttgggagcaactaaaaacatctgtttcccgaggcttctcaactaaaattcaggagcacttagcaatgggcgttctactttcgttaggagtgaatcatgttaatcatttacttttatcatatagtaaacaatcattgataagtcgttgttataacctgctgctatccgaacccggcacaaaatggacagcaaacaaggttgctcgatatctctacatttctgtttctacattacatcgccgtctagcaagcgagggggtaagtttccaaagtatactggacgatgtgaggttaaataatgcgttgtctgctatacaaacgacggtaaaacctataagcgagattgccagagaaaatggttataagtgtccttctcgttttactgaaagatttcataatcgttttaatataacaccaagagagataagaaaagcttccagagagtaaaagtgttttaagaaggagcaattctatcgattttgattttgggaaatcaacacggcataattatgtcaccggagcctgaacaactccggtgacttctgcgctaaacggggacgtttatgcgcacatacaatccaaactctcttctcccttcacagatgcagaaatgcacctgcaattctttgcatctagcgtttgacctctgcggaggggaagcgtgaacctctcacaagacggcatcaaattacatcgcggcaacttcaccgctatcggtcggcagatccagccttatctggaggagggcaaatgctttcgcatggtgcttaaaccgtggcgtgagaaacgcagtctttcccagaatgcactcagccacatgtggtacagcgaaatcagtgaatacctcatcagcaggggtaaaacgttcgccactccagcttgggtaaaagatgctctcaaacacacatatctcggttatgaaaccaaagacctggttgatgtcgtaaccggtgatatcaccactatccagtcgttacgccatacctccgatcttgataccggagagatgtatgtcttcctgtgtaaggttgaagcctgggcgatgaatattggttgccacctgactattccacagagctgcgagttccagctgctgcgcgacaagcaggaggcgtaatggctacaccgcttattcgtgtcatgaacggacacatctacagagtaccaaatcgtcgtaagcgtaaacctgagctgaagccatccgaaataccaacactgctcggatataccgccagcttggttgataaaaaatggttgcgactggcagcaaggaggagtcatggctgatttgagaaaagcagcgcgtggtcgggaatgccaggtaagaatccctggcgtatgtaatggcaaccctgaaacgtctgtactggcacatatccggctgactggattgtgcggcaccggtacgaaaccgccagacctgattgccaccattgcatgttctgcctgccacgacgaaatcgaccgccgcacgcattttgttgacgctggatatgcaaaagaatgcgcgctggaaggtatggcgagaacacaggttatctggctgaaagagggggttattaaggcgtgaatacctacagcatcacattaccctggcctccgagcaataatcgctattaccgccataatcgcgggcgcacgcacgtcagcgcagaggggcaggcataccgcgataacgtcgcccgaatcattaaaaacgcaatgctggatatcggcctggctatgcctgtgaaaatccgcattgagtgccacatgccggatcgccgtcgccgtgacctggataatctgcaaaaagccgcttttgacgcactcactaaagcaggtttctggctggatgatgctcaggtcgttgattaccgcgttgtgaagatgcctgttaccaaaggtgggaggctggaactgaccatcaccgaaatggggaatgaatgatgtttgagtttaatatggcagaacttcttcgccaccgctgggggcgtctgcgcttatatcgtttccccggttctgttttgaccgattaccgaatactgaagaattacgccaaaaccctgacaggagcaggagtatgaagtcagagataacaatcaactaatactgttttgttgatttttgcttgtaattggcgttctggtctgatttttgtggagtaagttgatgcgtgatattcagatggttcttgagcgttggggagcgtgggcggctaataatcatgaagatgtgacctggtcgtccattgccgccggttttaagggattaattacttcaaaagtaaaatctcgcccgcaatgttgtgacgatgacgcgatgatcatttgcgggtgcatggcccgtctgaaaaagaacaacagcgatttgcacgatttattagtagattattatgtagtcggtatgacattcatgtcactggcaggtaagcattgctgctctgatggttatatcgggaaaaggttacagaaggctgagggcataattgaagggatgttaatggcattagatatccggttagagatggatatcgttgttaataactctaattaatatgccaattgtttactaaaaattattaaaaatggggcgttgagacgcccccaaaaataaagggtaatatataacagaaggtttatatagttagaagcaaggttgtgcttctaaaggaagtggcttgagggagccacttatatgttggggaggcaacgcctcccgcaacatatctttttcgtaatcagattagaactggtaaaccagacctacagcaacgatgtcatcagtgcttacaccgagtgctttagggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccttagtgaagtcatttttgtcaagcaggttgattttgtaatcaacgaaagtagacatatttttgttgaagtaataggttgcacctacatcaacatatttgactaagtcctgatcgccccatactccaagatccttacctttagattgcaggtaagcaacggacggacgcagaccgaaatcgaactgatattgtgcaacagcttcgaagttttgggctttattagcaacgaagtgatcagcaaatacagtcatattctgggtttcagaataggtagtggccaggtaaatgttgttagcgtcatatttcagacctgcggcccaaacttctgcatttttaccggaagcaaatacttcaggaagaactttccctgcattaacttgagtgtcggtacgatcagatttcgcataagttgcaccgataccgaatccttcgtattcataggtagcagagaaaccgaagccatcaccgttaccttcagtgtagttatcgaaatcgctacgatcgtttttgccttggtactgagcagcaaagttcagaccatcaaccagaccaaagaagtcgttgttacgataggttgcaacaccagttgcacgttgagtcatgaacacgtcggtttgagtccaagtgtcaccaccgaattctggcaggacgtcagtccacgcaccgatgtcgtatgctacaccgtagttacggccgtaatcgatggagccgtagtcaccgaatttcaggccagcgaaggcaagacgggttttatctttggaggaaccttgagattcagcgcggttgcctttgaattcatattcccactgaccgaaaccagtcagttgatcgttgatttgggtttcacctttgaagccaagacgggcataagtagtatcaccatcatctgcatcattagaggagaagtagtgcttagcattaactttcccgtacagatccagcttgttactgtctttattataaatttcagctgcctgagcagacatcgccattagtactgatgcagctacagcagaaattgccactgttaattttttcatcgtgagccctttttttgaactattattaaaaaatgatgtcactgcgcgataaatattcatctaatcaatgtgattatttcaagatgtaagttttggtttctcgtttgatttgtgaagtagatctctatttttatctgaacttttttctatcgaatcctattcatggctcttggctgaataaaaataaatctattagccaatttatattaacggctgttatttataagtgctctataatttgaaggttcaatttaaaccggctaaaaataacactggaaattattttttggttatttgttgagatttgcttatgtatttgtagtggtgttttcaatactcggtagcattctctcaaatatcatttagtggtttacgtacgtaaaaaattggttatgctgttaagagtggttacttcgtcacacagcttaaacccgccgtcgagcgggtttttccattttttgagtctcgatattagctgataacccaatacctgagttattcactgactccgagtctgttacgtttcgtagtattccctcaatttacacccgctttgtctgcgaggtggggttatgaaatccatggataagttaacaacgggtgtcgcctatggcacctcagcaggtagtgccgggtactggtttttacagctgctagataaagtcactccctcacagtgggcagcaataggtgtgctgggtagcctggtatttggcctgctgacgtacctgacaaacctttatttcaagattaaagaagataagcgcaaggctgcgagaggtgaataatgcctccatcattacgaaaagccgttgctgctgctattggtggcggagcaattgctatagcatcagtgttaatcactggcccaagtggtaacgatggtctggaaggtgtcagctacataccatacaaagatattgttggtgtatggactgtatgtcacggacacaccggaaaagacatcatgctcggtaaaacgtataccaaagcagaatgcaaagcactcttgaataaagaccttgccactgtcgccagacaaattaacccgtatatcaaagtcgatataccggaaacaacgcgcggcgctctttactcattcgtttacaacgtgggtgctggcaattttagaacatcgacgcttcttcgcaaaataaaccagggcgatatcaaaggcgcatgtgatcagctgcgtcgctggacatacgctggcggtaagcaatggaaaggcctgatgactcgtcgtgagattgagcgtgaagtctgtttgtgggggcaacagtgagcagagtaaccgcgattatatccgctctgattatctgcatcatcgtcagcctgtcatgggcggtcaatcattaccgtgataacgcaatcgcctacaaagtccagcgcgacaaaaatgccagagaactgaagctagcgaacgcggcaattactgacatgcagatgcgtcagcgtgatgttgctgcgctcgatgcaaaatacacgaaggagttagctgatgcgaaagctgaaaatgatgctctgcgtgatgatgttgccgctggtcgtcgtcggttgcacatcaaagcagtctgtcagtcagtgcgtgaagccaccacggcctccggcgtggataatgcagcctccccccgactggcagacaccgctgaacgggattatttcaccctcagagagaggctgatcactatgcaaaaacaactggaaggaacccagaagtatattaatgagcagtgcagatagagctgaccatatcgatgggcaactcatgcaattattttgagcaatacacacgcgcttccagcggagtataaatgcctaaagtaataaaaccgagcaatccatttacgaatgtttgctgggtttctgttttaacaacattttctgcgccgccacaaattttagctgcatcgacagttttcttctgcccaattccagaaacgaagaaatgatgggtgatggtttcctttggtgctactgctgtctgtttgttttgaacagtaaatgtctgttgagcacatcctgtaataagcagggccagcgcagtagcgagtagcatttttttcatggtgttattcccgatgctttttgaagttcgcagaatcgtatgtgtagaaaattaaacaaaccctaaacaatgagttgaaatttcatattgttaatatttattaatgtatgccaggtgcgatgaatcgtcattgtattcccggattaactatgtccacagccctgacggggaacttctctgcgggagtgtccgggaataattaaaaacgatgcacacagggtttagcgcgtacatgtattgtattatgccaacaccccggtgctgacacggaagaaaccggacgttatgatttagcgtggaaagatttgtgtagtgttctgaatgctctcagtaaatagtaatgaattatcaaaggtatagtaatatcttttatgttcgtggatatttgtaatccatcggaaaactcctgctttagcaagattttccctgtattgctgaaatgtgatttctcttgatttcaacctatcataggacgtttctataagatgcgtatttcttgagaatttaacatttacaacctttttaagtccttttattaacacggtgttatcgttttctaacacaatgtgaatattatctgtggctagatagtaaatataatgtgagacattgtgacgttttagttcagaataaaacaattcacagtttaaatcttttcgcacttgatcgaatatttctttaaaaatggcaacctgagccattggtaaaaccttccatgtgatacgagggcgcgtagtttgcattatcgtttttatcgcttcaatctggtctgacctctttgtgttttgttgatgatttatgtcaaatattaggaatgttttcaattaatagtattggttgcgtaacaaagtgcggtcctgctggcattctggagggaaatacaaccgacagatgtatgtaaggccaacgtgctcaaaccttcatacagaaagatttgaagtaatattttaaccgctagatgaagagcaagcgcatggagcgacaaaatgaataaagaacaatctgctgatgatccctccgtggatctgattcgtgtaaaaaatatgcttaatagcaccatttctatgagttaccctgatgttgtaattgcatgtatagaacataaggtgtctctggaagcattcagggcaattgaggcagcgttggtgaagcacgataataatatgaaggattattccctggtggttgactgatcaccataactgctaatcattcaaactacttaacctgtgacagagccaacacgcagtctgtcactgtcaggaaagtggtaaaactgcaactcaattactgcaatgccctcgtaattaagtgaatttacaatatcgtcctgttcggagggaagaacgcgggatgttcattcttcatcacttttaattgatgtatatgctctcttttctgacgttagcctccgacggcaggcttcaatgacccaggctgagaaattcccggaccctttttgctcaagagcgatgttaatttgttcaatcatttggttaggaaagcggatgttgcgggttgttgttctgcgggttctgttcttagttgacatgaggttgccccgtattcagtgtcgctgatttgtattgtctgaagttgtttttacgttaagttgatgcagatcaattaatacgatacctgcgtcataattgattatttgacgtggtttgatggcgtagatgcacgttgtgacatgtagatgataattattatcattttgtgggtcctttccggcgatccgacaggttacggggcggcgacctcgcgggttttcgctatttatgaaaattttccggtttaaggtgtttccgttcttcttcgtcgtaacttaatgtatttatttaaaataccccctgaaaagaaaggaaacgacaggtgctgaaagcgagctttttggcctctgtcgtttcctttctctgtttttgtccgtggaatgtgcaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgctgcaggccagcgagacagatctccagccagggactattgagtacgaacgccatcgacttacgcgtgcgcaggccgatgcacaggagctgaaaaatgccagagactccgctgaagtggtggaaaccgcattctgtactttcgtgctgtcgcggatcgcaggtgaaattgccagtattctcgacgggatccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgctaattactatctcccgaaagaatccgcataccaggaagggcgctgggaaacactgccctttcagcgggccatcatgaatgcgatgggcagcgactacatccgtgaggtgaatgtggtgaagtctgcccgtgtcggttattccaaaatgctgctgggtgtttatgcctactttatagagcataagcagcgcaacacccttattccagctggcttcgtggctgttttcaacagtgatgagtcatcgtggcatctcgttgaagatcatcggggtaaaacggtttatgacgtagcgtcaggggacgcgttatttatttctgaactcggtccgttaccggaaaatgttacctggttatcgccggaaggggagtttcagaagtggaacggtacagcctgggtgaaagatgcagaagcagaaaaactgttccggattcgggaggcggaagaaacaaaaaacagcctgatgcaggtagccagtgagcatattgcgccacttcaggatgctgtagatctggaaatcgcaacggaggaagaaacctcattgctggaagcctggaaaaaatatcgggtgttgctgaaccgtgttgatacatcaactgcacctgatattgagtggcctacgaaccctgtcagggagtaatcattgggattatgccgcagcacgtcttaagcaagaacatgctgcggttggatgctatttttttcctgaagcggaaaacattactacagtaccttgaaccttggttttaacattctcgaaatgctctgagagtatatgtgttaagccttcttcggaatcttttgtgtttgaaaagatgcctttctgattgtaaatgcgcatcagtttttgaccgaagctattgtgcacaactccatcgccaagaattgtggctccgtatagagttccatcgtcagttaaggcctgcgccgcattgcgtattacacagctttttgtagatatatttccaggcaggcagtgaagaaggtaagacatggaaatggaatcaaattgaccatgtaacgccgcgggataaggttcaaaaacatcatggctaattttatgtttaatttttgattccccagcccttgtagatgccgcgttcaggctagcttcgttcaaatccattaaagatatcagactactctcaggtacgtgagtaaggtaaaacccagttccaacaccaatatccagatggttgttacctaaatgttccagaaagtgtggaagaaggtgttcctttgtaggacatccccatgcaagccgatttgatactcccaaaacccaccagtcataaagctttagggtaagtggtgtgtaaattctagccccatcatctgtgtttttttattaatttcaccatgttatagttttatttgtgaattaaatcaattatggcaatgaattacaaggggttaaatgctgccgcagcatagcgatattgaaatagcctggtatgcttcaatacagcaggagccgaatggctggaagaccgtcaccacacagttctacatccaggaattcagtgagtatattgcgccactgcaggatgctgtagatctggaaatcgcaacggaggaagaaagatcgttgctggaagcctgaaaaaagtatcgggtgctgctaaaccgtgtggacacttccgtagcaccagatatcgagtggcttattcaaccataataaacagtatgtatatcataggttattaattgtgagttttttcggtgtgttatttgtttgtttgatgttatgcttttgcgccccaaaaggttgtttagatgtattttatcaattgattttcaatatcgtttaataaagaaaaattaagcaagctggatgttggttttttgttaattgaatggttctaataatgtttttttactgttgttgaatgtgacttgataagaaatgcaagtaaaaatgatactctttttattttaaattcaaacggttgacatatatatagcaagaggtttcaggtgcgttgtagtgagtttatgttaataaaaagcatagtaagcgttgaaaaatgtaactttgaaataagttagaataaaaaacaacatacatataataatttaatcttaaatgaaatttattaaaatttgcaaactataattttgtgtataaaaatataaatgcacatcatcctgattatgattgtgtatttaattggttgttatttgactactatcaacttgttttaattttatgataggtgcaagatggattatgtttgctccgtagttttcatctgtcaatcatttgatttaattataaacaggagagttatctcgttcaaaaaaaattcattgtttattgtaagcgacaaaattagaagggagttaccagtatgcccctctaaactaagaattgttgatatagataagaaaacatgtttatccttttttatcgacgtgaataatgagctgcctggcaaatttactcttgataagaatggctatattgctgaagaggaacctccattatcgcttgttttttctctgtttgaagggattaaaatagcagactcacactccctttggttaaaagaaagactatgtatatccttacttgccatgttcaaaaaacgcgaaagtgtaaattcatttatactaacaaatataaatacatttacctgtaaaattactggaataatcagttttaatattgagcggcaatggcatttaaaagatattgcggaattgatttatacgagtgaaagtttaataaaaaaaagattaagggatgaaggaacgtcatttactgaaatattgagagatactaggatgaggtatgcaaaaaaactcataacttcaaactcttattctatcaatgtcgtagcccagaaatgtggctataacagtacttcatatttcatatgtgcatttaaagattattatggtgtcacgccatctcattattttgagaaaataatcggcgtcacagatggaataaacaaaacaattgactgataatgtttattacaagttgtctacatgttaattataatattatacagcgttttttttgatgtgatattctggaaccattaatttgtaattgggttgctgtcgcctattttatacatactataattgatggttttctatgtgatttagttaataaccttctgggtttattttaagggttaattgttacattgaaatggctagttattccccggggcgattttcacctcggggaaattttagttggcgttcttaaaatgtgtacttaagaccagcagtagtgatgaagttatagttttctatacctgctccatttttgctgtagtctgaagtgttattattgtgatcataaagtgaagtattaccttttttattcgtaacccgattccatgcgccttcaacataaacttttgcgttaggtgtgacgtaataacctgcattgactgcaacagaatagtaattttggtctttgaccttactgcgataagtgattctttttcccgggtcatagtgttcatcgttatcagatgattccacccagccgctgtatttaaatgtgccaccgagttcaaaatcttcataacgataacttccagtcaagccaatgtagggcattttaaaacgttgtttgtagccgattgctctttctccattcgggaaggagccgatatcatctctgaatccctcctcagaactgtagatataggaaccacctctggctgtaaagctataacggctttcctgatatccggccatgagtcccaggcggtaattgggttcgttgaggagccagcctttgatattcagatcaaattcgttggcataattgagttgtgtatcagggtgtctactttcatccgtccaggttccggggttactggaatccatccagtcctgatcgaccatattgccacctcggctgccgagagttgtccagccagcagccccgatagatatctggggcatcaaatcccaattaattgcacctttaataattgcagcgttattgaatttccagtcgagttgactgacttttcggcctccttcttcggctagataaacacgctcttttgtttttccgctcagagttccaagactaatgtccgcatttatgttgtcaggagtaaacgataaagtctcggtagaagcaaaagagctgatcgcaataggggttgtcaggactattcccagaagtttcgcccgcataaaagttctccattcaatcgttttaatgattgaatatgtattttttatatctaacttaatgagtcaattacatattgctccactgtttatattttgtttagtattgaatgattatcacaatgcgctatctgtttttggtttaattatctgttattgtttcatatttcggttttactgtgtggtttttttatgcttttgtggtgcttttatctatttaagtgccatgcctttagaggcatataagcgaaaatagcatgaggtttatcctcaattactatgttttttagtacaaaaaagagggacaaaactgagacacataaggcctcgcaatggcttgcaaggctttacatgttttgaggtagtgggacgtgtgagcgcagagatggcgcggtaagttgttgacttaaaatgtcgttctaggaacttctaagtcgtgggccgcaggttcgaatcctgcagggcgcgccatttcttcctcatttatgcccgtcttatccgtttccgctttgcccttcaccacatcactttttgtcgctgtttggcgagataattcaacggtgtcaggccgtaaaacgccttaaaaacagagataaagtacgacgtgctgctatagccacataattgcgccacctgagtgatatttttgttatccatcaataacatctgtacggcgtaacgcatacgacactctgtgacaatctggctatagctggtattttcgttttttaatttctttttgagcaggctggggcttaaacatagcgaactggcgacaattcgcagattccagtaatgctgaatatcgctttgaataatgcggcagacgctgtcgcggacgctgctgcgtaagatatacatcagtagggcaataaaccgcgattgctcaagaaagttagacaatacggtaaaaagcaatgcgcgcgtcaactccgcttcgcagggtctgctgggttgctgcttgctgtggttggcggctagccggaacacttccggtgtacggctatgacaagcgataaccggggttgccagccgcgaccagggctttacacaggttaagttcttatttaaaaacaacagataatcgttgatgatgttacggttgatgtgggtgattaatacgtgatttaacgttgagagttcaatgacgttattgttgcacgcgaaggcggccaggtagtttttcggaagggtaaacgtagcatggttattgacgcttacctctacctctttttcggtcaggatcaccacgcaaggttcactgctgctcaattgcatttcgcactcctcagatatcagaaactccgctcaaaggatctatgcttcctgcatgagtgatcggcccgttcgccgataacgatcttctttctttagcacgctttttagcaattaatcttgatggaattctgatgagagcgaaagaggtaagccaggtcgtacccgacttacctggaggagatttaatactcgagaatgccgtgcgcgacgggcaaatagcgcagagagaaatagagagtgtctttaccgcaagaggaacgtttcgctaacagcgaggcaatttctgcgtccggtttcggtttcgctgtaaaggttttgcctttgccggcgacaaaaagttcataaacaacgccgctggcaggggcgggactttggcaatcggcgctggcctgtaaataacgttcacgctgttcagcggtcagtttatccacgccgctgccatcctgtacccagacattaacgccggttgctttaacgtgttccagcagttggcgatagccatcgggcgacatgtttccggcgaaaaaactactgatataaaccggttttgctgaaacatcgctaatcagccgctgcgcgttgtttaaccatgttagcaaaggctgacgggcggcttcgctgcgccagttcaggtcgtcaatttccgcgctgatgtaccagccatccggcgttatgccaggcgcggcgctccataatctggcttgctggagatcggcagccagcaggcgattaagatagctttccagcgctgcggacgactgtttctggtgcataaaaaattccggatcggcgttcagcccgacaataagcttcagaccagcctgttgcgcagctgcggcccgcttaaacaataacgtgcgctgttctggctgggtaaatgcatcgccgtaacgggtccattgcaaaacaagggtatcgaagccttgcaaacgtaactgactcatcagcccctgccactgggtatcggtaacctgactatctcggttttgtggttgccagataatacctttcatcgcaaaggaaaaagggctgaccaaaagcagtgtcagcaatacgaaaatgaacttacgcatttaccagtgcactccaatggtgagaaacgcgttgttgcgctctccgttacgttgattaatcgccttaaaggtatgttgatactcgacgccgagactgactttgtgcggccaggcgtcgtagtgcgtctcgccggtccagatattccagcggaccccgactccgccaagctgcgcgccctgagtgcctttatcacgatagccgttgtcctgaacgtgagcgtaaggctcaatagtctgtccgttagctaccttctgatgccagctgacgcgataatctgccgtccacgcctgaatatcctggcggatatattgcgccgcatcgaggtacaggttttgggcaaaccagcctgaaccgttcgggtgccattcgtcgctgtatttgccgccattaaagaatgaggcgctggcgcgcagcatggtatcggatgcgccattttggccgttcagcggcaactgctgttcgacggcgatgaaaaagatctgatcgcgcagcggcttccagcgcagaccggtgccggacatcggatttttcaccggcatcatcaccccgttttctccggtatcggcaaagacgcggctataaactgagagcaggtcgccttccagcagcatattgcgtccgatgcggtactcggcttccagttgtccgtagctacgatagcttttccctggcgctgcgccgccgacattattgttagcggtactcattgcgccggaacgcaagccgatggaagaatcgaaactgaacgtccagcggcgaccgacctcctcatgcaaacggcggaaattgaagcgttgttgattttgttctggggtcagtggggttatcagcgcctgattatcaatgtcatcaatcaccagccgggcgtagtgctgcgtcgcaggcatgtcatccagacgctggttcacgtaggccagttgtcggatcagtgccggatcgtccggaagccctttatgcgccggttcgagcatttcccgcgactgtgcgatatcaccgctatcccacaaggcgtaaccaagcgctgcctgggtgttgctattattcggttccagttccagcgcggcgcgcaaatcactcaccgcggccgggacattatgacgttggcgataaattgtcgcccgcgcaacgtaagcgttggcagaaggcgcaatattgattgagcgcgtgagatcgttcagtgcgagttccggctgaccaggaatgtaacgttgcgcatgcagccaccagtagagggcattgcttcccagtccacgtttttctgcctgttgtagccagcgatcgcgagccgcaccatttcctgccgcctgggcggtattggcagcagcaagcagatcctcattgctcatgtcgtgaagactgattttctgccaggccgccagtgcggtggcgtagtcctcaacctgatacgcctgataggctaccgcacgatgttgccaggcgctcggttgtcgttgttcggcctgaagccatgcatacaacgccacaccgggtagcgtgtcccgataacactttgccagacggttccaggcggcggcatcgtaggaaggcgacatatcgcccagcaagcgaactattgccgggcaattatctgcaatacccggcaactgactttgccactgacgttgctccgccagcggtaagggtttcgataaaatcgccaccttcgccggcgttgccaggtaaggatgactttccagcagagacgccagtcgcgccattaaagtctggctgacacgcgcatcgccctggaaaggatagcgttgcagcaataaatcggcagcttcgcgtgactgctcgttctgcatcagttgccaggttagttgatccaggcgggtaagatttgccggttcttgctgatacagcaatcgtgccagacgcagagcttcagccttgttacgggtcgccacgctgacagcataacgctcctcaagcatttcattggcggggagggtggcgagcagtttttgcgctgcgtcgtactgaccttcttttaacagcaccggtagcgtcgcgccaacaacatactggcggttgtcggcaaactgtaccgtataattcgccaacgcctgaacggggttagcgctgtatttagataacagatagagccaacttttctcttgtgcgtccgtggtaaatagtggcttattttcaatgagataatgctggaggcgtgctttttcgccacgataagccagcgcggtcgcgtaagtaatatatgactgaggatcggtgaagatcccctgtgattgcagtgccaggatccgatcgtccagctgcccggcaagaagcacgtcaaaccactgacggcgttctgccgcgcttaatgtgttctgctggcgtgcttcattgtatagcgtatctgcctgggaccattgtttcaggtagattgcccgttgcagcagatcggttcgcagcgtttttccttccggcgatgcagcaaacgtcgcatcgttcagttgcgctctggcgacaggtaactgtgccagccgcagggcattctgcccgacttcactgcgacaacgcagggtcggcgcagcatcgcacgctttttgctgggcaagcagttcttcaactgtcgtaacgcttttcacttcaaccggaatagccgccagactgcgctcaagtcgggcatctcctgggtgacgtttcagttgatcctcaagcaacagccgcgcccggtcatcatgaccaaaatggcgataggcttccgcaaggtataaagtcagcggaatattatccggcacctgctggtgtatatattcaaattcgcggatggcggttgcttcgtcgttatttttctgtgccttcagcgctttatcgagacggggataaataacaaaatggcgataatcgctcagccccagctcttctgcgctggtgccgatattgtctgcgagtgcgctggtactcaataaagacgtcagcagtaaaccagaccatccgatgacgcgattaaggttattctccttcattttcggactccagttgcgcaacctgttctgtgtttaaacctgctttgagtaatagtgattgcatcgaaacttgtaattcgcgttgaattgtcaggacgcgatccaacgtttcctggctgataacgccttcggtgaccaaaaacttgccgagcggcagagaactgcgttcatggcgcaataacaacacgttaattgctgaacgattaatatgaccgagcgtggtcagtatttcggcgaacaggaactgatgcggcacatattgccgccagatttcaccggcctgctgttccgtgagccactgatgctgaaccgcattgtacaacattgcccgcggatcgtgaccgcgtcggcgtgcataccagtgacgtaaccctgtgacaatttgtccccgcagaacaatgacgtaacgcactttgcgtccgactttacgcgtcagggccgccagcgaaaccgggtcaataccatcttcactgccgacaattaactcgtcattttccagacgcagcggcagtaccgcataatgcagcgccacggaggccggcatttcggcaatcagcgaggaagggatctgccaggcatcgatggattcccacgccacgccgttttgctctgccagcgcctgtgccagctgctcggcgctaatcagcccctgcatcagcattgaaccgcccaggcgtagaccttcgacgcgattacgcagtgctgtatcgagttgttcttcagtgatgacctgattttccagcagaatttgacctaacgggcgcaacgagcgggtatcgccagtcacgctggggaagtcatgcgttgttttatcccacgccacgcgacgtggatcgccgtgttgaagtacctgttttagcgcgcgccagttggccatgaagttaatcaggttgccccagaaaagacgcaggacggaaagcagcccctgcgtcaggccgtagtagccagtaacgaaaatcacccgctgcacgatgcggttaaccatcaaaccaaagtttagccacagcagggtcattaaccatgcgctgccgctgaaaatagaaaggaaatgccaggcatcgggccacaaactttcatacgccagcaacagcaaaagctggatcatcaccagcatcgcgaggaagctgacaaagttactgattgcccctttgcggtcgcgccagagaaagtagttcagcgtcaggctggaggtccatttatgggttttaaagccttggaaaacaatgccgatgatccagcgggatttttgtcgaaccgcagtcgaaaaggtatcggggaaatattcgcgcacgcagatcatgtttgatgtccgcgcgtgctgtaaaaatttacgctgctcgcgttctttggcttcgtccaccaccggaaaacggacaaaaatttccgtcatacctttttctttcaggcggaagccaatgtcgtaatcttcagtaagactctgcacgtcgaaagcaataccgtcaccgtcagctaacagtgcggtcacggcgcggcggctgaaacaggtgccgacgcctgcgctgggcacttgtccggcgagggcttcacgcaccggaacatctttgccatgcagctctgaaaactcatcaatgtaagtcatgctggtgaagtgcgtccattcgcgttcgaacggatacaccgggatctgaatcagatctttacgctcgaccagatagttgaacagacgcaattccatcggtgaaatcacatcttcggcgtcatgcagaataaaaccagcaaaagcgaaattggcgctacgctcaaattgggtgatggcgtccagcacgttgttcagacagtcggctttgctggtggggccaggacgcgcgcagactaccttatgcacattcgggaagcgagcgcacacttcgtcaacatcacgctgagtatcggggtcgttggggtaggtgccaacaaagatatgatagttttcgtagtcgagcgtggtcgccgccagctcggccatattgccgatgacgcccgtttcattccacgccggaaccataatcgctaacggtttttcatctggtttatacagttcgcggtaactcattcgcgggtagcggcgataaacactcaacttgcgtttaatgcggcgtacccagtagacgacatcaataaaaaaatcgtccagcccgctgatgaacatgatgaccgctaacgttatcgcgattacttttaagccgtagagccaggtagcaaaaacatcaagaagccagtccacacaaaaaccttacattaacgctggttatgtttagggtggcgtatattaaggttttttatgaattgtgacagctttttaccattaataggtatgactattgcggcacgttatttttacactggttataaaagttgccgtttgctgaaggattaagcgggtaatgtgataacaaaccttgtcccccgcgcatccgacgttaccgcaaccgtgcctttatgcgcgacaacaatcgatttcactatcgccaggccaataccgctaccttcaccttttcgctggcgggaggggtcaacgcgatagaaacggtcaaacaatcgcggtaagtgctcgggcgcaatgggcgtaccggggttttcgacgataacttgcaccaggtgatcgaccgtctgacagcgcactacaattgtctctccggttggcgtataacgcagggcgttcgaaagcaggttgcttagcgcccgacgcagcatcagcggatcgcccgcgacctgacacttgtcgccaacaaaccgcaactccacgccgcgatcttccgctaacgcctcgaaaaaatcgaacactttgccgacttcatccgccaggttgagcattttcttttcggggattagctggttgttatcggcctgagcgagaaacagcatatcgctgaccattttcgccattcgcgtcagctcttcgagattagagtagagcacatcttccagctccttctggctgcgcgactggctgagggcgatttcggtttgcgttatgagattcgtaattggtgtgcgaatttcgtgagcgatatccgctgagaaattggactggcgggtaaagacatcctcaatacgctcgatcatatggttgaacgacagtaccagctgttccagctcaatgggcacggtctgcgggtcgaggcgaacgtcgagatctttcgaggtaatattctggatttgacggctgacgctgcggatcggcgcgtgacctttatgtaccgccaacagtacgataaagacgatcaggatgctgattaccgatgcggtcataataagtttattcatcaaatcatttatgtaatgaagatgaaaatcgatcgaaagcgcgatgtagagcgtataaatcggtttgccgtccaccaacgggccaaccggcaagttaatcatccgccagttgctgtgttccatatgcccgtgaccgtggcctggcatcatcatcgtcgggccggaaaggagatacacctcgccaccctgagcgtctttatcgggtatggcgtcacgcgtaaactcgcggatatccggcgcaccgggggagtgatacaccgttttaccctgactatctgccagggaaatcaacacattggaataaccactgacgatatcttccagcgtcattaagcgtcgggcttgcgtttcgtcagggtgatttagtacccgttcaagggtggcgctaatctcttttaaatcattaatatcctgctcggcaaaatgaacttttactgagtggatcatgatccatgcaaaggcgaaaaacgccgcgatggtggccaggctgataaaaaaggtcaggcgggttgccagcgaaaacgggcgctgaaatggcttactgaccatccggcacctcaagcatgtaacccacgccgcgcacggtctgaattagcttcggctcaaagtcgttgtcgattttgccgcgcagccgcttcaccgccacatcaatagcattggtatcgctgtcaaaattcatgtcccatacctgcgaggcgataagcgagcggggcagcacttcgccctgatggcgaaggaagaactccagcagagtaaactctttactggtcaaagtgatgcgcgtgccgctgcgggtgactttgcggctgacgagatcgaccatcaaatcggcaacctgaaactgactttcgataatcaccgccgccccgcgccgcagtaatgtgcgcacccgcgccagcagttcagcaaaagcgaatggcttcaccaggtagtcatctgcccccaactccagccccttgacgcgatgttcaatggtgccaagcgcggtaagcaacagaatcggcatccctttattggcggagcgtaacatgcgcacgatatcccagccgttcacgtccggcagcataatatcgaggattatcagatcataatcaccggtcatcgccagatggtagccattcagcccgttgtcggccaaatcgaccacaaaaccggcttcggttaaccctttggtcaagtattctccggttttcttttcatcttcgacaatcaacagtttcatatttcctccgcatgttgcccgggcaattctagagtagcgggatcagatggcaatcgcttattggcaaaatgacaattttgtcatttttctgtcaccggaaaatcagagcctggcgagtaaagttggcggcataaaatcaccagaaattatgagcctatgtctccttgtaaacttctgccattttgtgtggcccttgcgctaaccggttgttcactggcaccggattatcagcgtccggcaatgcccgtgccgcagcagttctcactcagccagaacggcctggttaacgcagcagataactatcagaacgcgggctggcgcaccttttttgttgataatcaggtgaagacgctgattagcgaggcgctggtgaataatcgggatttgcgcatggcgacgctgaaagtgcaggaggcacgggcgcaatatcgtctgaccgatgccgaccgctacccacagctcaatggcgagggcagcggcagctggagcggtaatcttaaagggaataccgccacgacacgggagttttcgaccggccttaacgccagctttgacctcgattttttcggtcgcttaaagaacatgagcgaagccgagcgacaaaattatttagccactgaggaagctcagcgcgcggtgcatattctgctggtttctaatgtcgcgcaaagctatttcaatcagcaactggcgtatgcgcaattgcaaatagccgaagaaacgctgcgtaattatcagcagtcatatgcgtttgtcgaaaaacaactgttgacaggtagcagtaatgttctggcgctggaacaggctcgcggggtgatagaaagtacccgcagcgacatcgctaaacgtcagggggaactggcgcaggcgaataatgcattgcaactgttgctgggaagctacggcaagctgccgcaagcgcagacagtaaacagcgacagcctgcaaagcgttaaattaccggcgggattgtcgtcgcaaatcttattgcagcgcccggatattatggaagctgaacacgcgttaatggcggctaatgccaatattggcgctgcacgcgcggcattttttccgtctataagcctgaccagcggaatatcgaccgccagtagcgatctatcgtcattatttaacgccagcagcgggatgtggaattttatacccaaaattgagatccccatttttaatgccggacgcaaccaggccaatctggatatcgccgaaattcgccagcagcagtcggtggtgaattatgaacagaaaatccagaacgcctttaaagaagtggcagatgcgctggcattacgtcaaagcctgaacgatcaaattagcgcccagcagcgttatctggcatcgctgcaaattactttgcaacgggcgcgggcattatatcagcacggcgcagtaagttatctggaagtgctggatgccgagcgttctttatttgcaacccgacaaactttacttgatctgaattatgcccgtcaggttaacgaaatttctttgtataccgcacttggtggcggttgacagcaatatactcgtcatacttcaagttgcatgtgctgcgtctgcgttcgctcaccccagtcacttacttatgtaagctcctggggattcactcgcttgtcgccttcctgcaactcgaattatttagagtatgacttttaactccaggagagaataaatgaaaaaagcactgcaagtcgcaatgttcagtctgtttaccgttattggctttaatgcccaggctaacgaacatcatcatgaaaccatgagcgaagcacaaccacaggttattagcgccactggcgtggtaaagggtatcgatctggaaagcaaaaaaatcaccatccatcacgatccgattgctgccgtgaactggccggagatgaccatgcgctttaccatcaccccgcagacgaaaatgagtgaaattaaaaccggcgacaaagtggcgtttaattttgtccagcagggcaacctttctttattacaggatattaaagtcagccagtaacccaggtttaatgagatgaaaaaaatcgcgcttattatcggcagcatgatcgcgggcggtattatttctgcggcaggttttacctgggttgcaaaggcggaaccgcctgcagaaaaaacgtcgaccgcagaacgtaaaatcttattctggtacgacccaatgtatcccaatacgcggttcgataaaccaggtaaatcgccgtttatggatatggatctggtgccgaaatatgccgatgaagagagttctgcgtctggtgtgcgcattgacccgactcagacgcagaatctgggggtgaaaacggctaccgtcacgcgcggaccgctgacttttgcccagagtttcccggcgaatgtcagttacaacgagtatcagtatgccattgtgcaggctcgcgctgccgggtttatcgacaaggtgtatccgcttaccgtgggcgataaagtacaaaagggcacaccgcttctcgacctgaccattcctgactgggtggaagcgcagagtgagtatttactgctgcgcgaaaccggcggtacggcgacccagactgaaggcattcttgagcggctgcgactggcgggaatgccggaggcggatattcgccgcctgatcgccacgcaaaaaatccagactcgctttacgctcaaagcgcccattgatggcgtgatcaccgcgtttgatctgcgcgcgggaatgaatatcgccaaagataacgtggtagcgaaaattcagggtatggacccggtgtgggtcactgctgcgatcccggagtctatcgcctggctggtgaaagatgcctcgcagtttaccctcaccgttccggcgcgaccggataaaacactcaccatccgcaaatggacgctgctacctggcgtggatgccgcgacccgcacgctgcagctgcgtctggaagtcgacaacgccgacgaggcgctaaaaccgggcatgaacgcctggttgcaactcaacaccgccagcgaaccgatgctgctcattccgtcacaagcgctgattgataccggcagcgaacagcgggtgattaccgttgatgccgacgggcgctttgtaccgaaacgcgttgctgttttccaggcatcgcaaggcgtcaccgcattacgctctggtctggcggaaggtgaaaaggtggtttccagcggcctgttcctgattgattccgaagccaatatttctggcgcactggagcggatgcgctctgaaagtgctacccatgcgcattgagggaataaccaatgattgaatggattattcgtcgctcggtggcgaaccgttttttggtgctgatgggcgcgttgtttctgagcatctggggcacctggaccatcattaatacgccagtggatgcgctgccggatctctccgatgtgcaggttattattaaaaccagctatcccggtcaggcaccacaaatcgttgaaaatcaggtgacttatccgctaaccaccaccatgttgtcggtgcctggcgcgaagactgtgcgcggtttctcacagtttggcgactcttatgtgtatgtcattttcgaagatggcaccgatccgtactgggcgcgttcgcgggtgctggagtacctcaaccaggtacagggtaagctgcctgcgggagtcagcgccgagctggggccagatgccacgggtgttggctggatctatgaatatgcactggtggatcgcagcggtaagcacgatctggccgatttacgctcattacaggactggtttctcaaatatgagctgaaaaccatccctgacgttgcggaagtggcgtcggtgggcggtgtggtgaaagagtatcaggtggttatcgatccccagcgcctggcgcagtatggcatcagtctcgccgaagtaaaaagcgcgctggatgcttcaaaccaggaagcgggcggttcgtcgatcgaactggcggaagcggaatatatggtgcgcgccagcggctatctgcaaacgctcgacgactttaatcacatcgttttaaaagccagtgaaaatggcgtgcccgtttatctgcgcgatgttgcgaaggtccagattggcccggagatgcgccggggcattgccgaactaaacggcgaaggcgaagtggcgggcggggtggtgatcctgcgatccggcaaaaacgcccgagaagtgatcgccgccgtgaaggacaaactggaaacgctgaaaagtagtctgccggaaggcgtggagatagttacaacatacgatcgcagccagctcattgaccgcgccatcgacaacctcagcggcaagttgctggaagagtttattgtggtggcggtagtctgtgcgctgtttctctggcatgtgcgctcggcgctggtggcgattatttcgttgccgctggggttgtgtattgcttttattgtcatgcacttccagggactgaatgccaatattatgtcgttgggtggcattgcgattgccgtcggggcgatggtcgatgctgctatcgtcatgatcgagaatgcgcataaacggctggaagagtggcagcaccagcatcctgacgccacgctggataataaaacgcgctggcaggtgatcaccgatgcgtctgttgaagtggggccggcgctatttatcagtctgctgattatcacgttgtcgtttatcccgatcttcaccctggaagggcaggaagggcgtctgtttggcccgttggcgttcaccaaaacgtatgcgatggcgggtgcggcgctgctggcgatcgtagtgatcccgatcctgatgggctactggatccgtggcaaaattccgccggaaagcagtaacccgctcaatcgctttttgattcgtgtttatcatccgctgttgctgaaagtactgcactggccgaaaaccacgctgctggtggcggcgctttcggtgctgacggttctctggccgctcaataaagttggcggggaatttttaccgcagatcaatgaaggcgacttgttgtatatgccatcgacgctgccggggatttccgcagcagaggcggcgagtatgctgcaaaaaaccgacaagctaattatgagcgtacctgaagtggcgcgggtatttggcaaaaccgggaaagcggaaaccgccaccgattctgctccgctggagatggtagaaacgaccatccagcttaagccgcaggagcagtggcggccaggcatgacgatggacaaaatcattgaggaactggataacaccgtgcggctgccggggctggcgaatctgtgggtgccgccaattcgtaaccgtatcgatatgctctcaaccggcattaaaagccccatcggcattaaagtttccggcactgtgctggcggatatcgacgcgatggctgagcaaattgaagaagtagcgcgaacggtgccaggcgtagcttctgcgcttgccgagcggctggaaggtgggcgctatatcaacgttgagattaaccgtgaaaaagccgcacgttacggtatgacggtggcggatgtgcagttgtttgtgacttctgcggtgggcggggcgatggttggcgaaacggtggaagggattgcccgttatccaattaatctgcgttatccgcaaagctggcgcgatagtccgcaggcactgcgccagctgccgatcctgacgccgatgaagcagcaaatcaccctggcagacgtggccgacattaaagtctctaccggaccgtcgatgctgaaaaccgagaatgcgcgcccgacgagctggatttatatcgatgcccgcgatcgtgacatggtgtcggtggttcacgatttgcaaaaagcgatagctgaaaaagtgcagttaaaaccgggcaccagcgtggcattctccgggcagttcgagctactggagcgcgccaaccataagcttaaactcatggtgccgatgacgttgatgattatcttcgtgctgttgtatctggcgttccgtcgggtgggcgaagcgttgctgattatcagcagcgtaccgtttgcgctggtgggcggcatctggttgctgtggtggatgggctttcatctttccgtggcgacgggcactggctttatcgccctcgccggggtcgccgccgaatttggcgtggtgatgctgatgtatttacgtcacgccatagaggccgtgccgtcgttgaataatccacaaacattcagcgagcagaagctggatgaggcgttatatcacggcgcggtcctgcgcgtgcgcccgaaagcgatgacggtggcggtgattatcgccggtctgctgccgattctgtggggaacgggggctggttcagaggtgatgagccggattgccgcgccgatgattggcggcatgatcaccgcacctttgctgtcgctgtttattatcccggcggcgtataagctgatgtggctgcaccgacatcgggtacggaaataaaagcaggataccccgtttaaccgtgtggattgtgtcttgcgacgatgggcactaaatgttaaaaggtgcccctcaacaaaaaagacacacaggggaaaggcgtgaaaaacgcgtcaaccgtatcggaagatactgcgtcgaatcaagagccgacgcttcatcgcggattacataaccgtcatattcaactgattgcgttgggtggcgcaattggtactggtctgtttcttggcattggcccggcgattcagatggcgggtccggctgtattgctgggctacggcgtcgccgggatcatcgctttcctgattatgcgccagcttggcgaaatggtggttgaggagccggtatccggttcatttgcccactttgcctataaatactggggaccgtttgcgggcttcctctctggctggaactactgggtaatgttcgtgctggtgggaatggcagagctgaccgctgcgggcatctatatgcagtactggttcccggatgttccaacgtggatttgggctgccgccttctttattatcatcaacgccgttaacctggtgaacgtgcgcttatatggcgaaaccgagttctggtttgcgttgattaaagtgctggcaatcatcggtatgatcggctttggcctgtggctgctgttttctggtcacggcggcgagaaagccagtatcgacaacctctggcgctacggtggtttcttcgccaccggctggaatgggctgattttgtcgctggcggtaattatgttctccttcggcggtctggagctgattgggattactgccgctgaagcgcgcgatccggaaaaaagcattccaaaagcggtaaatcaggtggtgtatcgcatcctgctgttttacatcggttcactggtggttttactggcgctctatccgtgggtggaagtgaaatccaacagtagcccgtttgtgatgattttccataatctcgacagcaacgtggtagcttctgcgctgaacttcgtcattctggtagcatcgctgtcagtgtataacagcggggtttactctaacagccgcatgctgtttggcctttctgtgcagggtaatgcgccgaagtttttgactcgcgtcagccgtcgcggtgtgccgattaactcgctgatgctttccggagcgatcacttcgctggtggtgttaatcaactatctgctgccgcaaaaagcgtttggtctgctgatggcgctggtggtagcaacgctgctgttgaactggattatgatctgtctggcgcatctgcgttttcgtgcagcgatgcgacgtcaggggcgtgaaacacagtttaaggcgctgctctatccgttcggcaactatctctgcattgccttcctcggcatgattttgctgctgatgtgcacgatggatgatatgcgcttgtcagcgatcctgctgccggtgtggattgtattcctgtttatggcatttaaaacgctgcgtcggaaataaggcattcacgctacatccgacaaaacgatgtcaaccatccgaaaccgctctcatccattcgatgagagcggtttttttaattactgcttaaatgcacccgccagagagcgaatatcattgccggttggcgactgatgaagtcgcagaccaaactcttcgacaatcgcaaatatgtgatcgaatatatcagcctgaatgctttcatattccagccacaccacggtgttagtaaacgcgtagatctcgagcggtaaaccgttatcacctggagccagttggcgtaccattaaggtcatatctttacgaatccgcggatggttacgcagatattcgttcagataggcacgaaaggttccaatattggtcattcggcgcagatttaataccgactccgtagaaccttgctggcgattccactcattaatttcctgatggcggctggttaaataaggctttaacaaatgcgctttattcagacgttgcatttcgtcttcatcaagaaaacgaatactggtgacatcaatactgatactgcgcttaatacgtcgcccgccagatgctgacatcccgctccagtttttaaaggagtcagaaaccagagaccaggtgggaatagtggtaatggtattgtcccagttacgcactttgacggtggttaacccaatatcgatcaccgcgccatccgcgccgtatttcggcatctccagccagtcgcccagtttcagcatatcgttcgcggaaagctgaatacctgccaccagaccaagaatcggatctttaaataccaacatcagcacggcagccattgcaccaagaccgctgatcagaatcgctggcgactgaccaatcagcagcgagatcatcaaaatgccgaccagaatcgcgccgatcagtttaatcccctgaaatatccctttcagcggtaactgagatgctgccgggaatttctgcgccagattcaaaataacatccagcaacgagaagactgaaagcagcgcatacatcatgatccacaactgcgcgcaggtagtcagaatatctgccgcttcggtgcctttttgcagccagaataccgcctgaatattgacgataatcccctgcagggtaaaagctaaacggtggaagagtttattctgggtaatgatttgcaaccaaagccgtgaactggcgatggcacgtttttcgaaggtccgcagtaccacccaatgcaaaataatatgcaccacgacggcggtcagaaaaataataccgaaaatcatcaccatcgaggtggtgtgatcgatctcaatacccgctaaatcttcaacctgggatattaaatcctgcataacgtctcctttatacaacagcagcctatgatgacggctgaaacagggttatgcaaatcaggagaatctgagaggaaatagccgggcagatgcccggcaagagagaattacacttcggttaaggtgatgttttgcggcagacgagatttcggcagcgtagcgttaaaatcttcaacgctgtgatgacctaccggaacaaccaccagactggtgtagcctttctctttcagaccaaattctgcatcgaggatggcggcgtcaaaaccttcgatgggtaccgcgtccagacccagagccgccacgccgagcaggaagttaccgacgttgagataaacctgttttgccatccactctgcatcatcatgcagatctttacggtgcatatcagcgaagaacttgcgacctttatcgttcgcggctttcgcttccggcgtggcaaagcggccatcggcatcttcctggtcaacaaccagcttcagccagacatcgtccatcgcggtttttgcacagaacaccacgacgtgcgaggcatcaagcattttacgctcgttgaacacgtaattaccggcagcggatttggcaacacgcgctttaccttcttccgtgctggcaacaataaaatgccacggctgggagttggtgctggatgggctgtattgcagtagcgttttgatctgctcggcctgttccggggtaagttttttgctggcatcaaatgccttagtggaatgacgctttaaggcgacagaaatgatatccataaagactccatgtgaaagtaattttgcgtgccagcagattacaaggttcaacgagaaatggtaagcgagaaaaatgcgctatagatttccgctttagcctggacgcactcttttttgatcgcgtttagccagaccatcaaccaccagattccacgaatcgttgatcagatcgcgaagtaacgcttcggagatttcttcgccgggatacactgaaatccagtgctttttattcatgtgataccctggcttaatgcttgggtatatttgctgatttaacagggatttttgtggatcggacttcagattgataaaggggacgccgcgtagctccgacgacagcataaaaatcttgccgccaattttaaaaacatcgaactccgggccaaaaggccagcaaagctcgacaaagggtaactcaagggccaggcgtttcgccgtttcgtgcagtgattgcttatccataaacgttcctttaggcgaaggagaataagcaaagtatgccgcgaagtacggcgataatcgacgtttaatccgccagcgagaaccagcgtcgccagataaagcgcagaacaaaatactcaatagcgcccagcactaaaaaccacagacaaaacaataaagtgtaaagctgactaagatccatcagatggaacatggtcaccagtttttgtgccagcgccagccccagtgcgggggcgggcagcagcaggcaagagaggaaagccatcagcaaaatgcctgctgcggtggtcaaggtttctaaagggtgtttcataacattgttaaatgtaagttaaaacaccattgtcagggatattcttctgtaaggcaattcccggcttagtcaccggcccagatctcacaatgctttttcaccagcccaatcagcgagccgccatcggcgacgaaatcgcgcattagctgcgcttcattcagaccgctgacgacctggcgatgcagggcctcaatcgcgctcgatgcaccaattttatgtgcggaaggggcgattttttccagcaatcgcaaggtatcttccgttagcggtcgacgatctccagtgtgcggatcggtgatgacgccttcaagcccatagcgacaggcctggaaacggttgaatttatacagcaggtaatctttttcctgatgtttaaacgggcgttccgtcagtaaccagtgggcggtagcctgaattaatcccgccatatttactgcgtggctaagggttaacggggtatccatcacccgaacctccaccgtgccaaaatgaggactggggcgaatatcccagtgcagatctttaatgctgtcgatcatcgtggtgtaactcagacagcgaaacagggcttcaaattgttgccagttactgacccacggcatcgggccattatcaggaaaggcggaaaaaatattcggtcgtgaggaggcaaaacgcgtatccgttccctgcatatatggcgacgcggcggaaagggcgataaagtgcggcacaaatcgtgacaagccgtgcagcaaataaatggcgtcatcgccactggcgcagccaacatggacatgctgaccaaaaacggtcgcctgctgaatgagataaccaaagttttccagcgtgcgttgatagcgttcgttatcgcatacctcctgacgctgccatttctgaaacgggtgcgtgccaccgccgcaaatttccagatgatggtctgtggctgcctgcaatacgactttctgcatcgctgaaaactgcccggcagcctggttgatatcacggcaaacatccgtcgccagctccagcatactttcggtgatatcgtgctttacctctccggccgtgatcttatttttaaccgcgtcaatcagcattgaagagtcctggcttaagtcatagcccggcggattaaccacctgcatttccagttcaataccgagggtaaaaggttcagaaacatgaaaatcgggtaatggcataggtttctcttatgttggcgttttctattcagtatagaagtcggagcggctgggcgagatgcggaagttctggaatgtttcttttttttggtgatggtgaactgatggtgcctgaagcaatttggctacttttgcaatgtgacaagttatggcagtgctgactggtggcgaagaattttgacgattgagtcatgcagaaaaaaacgggttcagcttcagttgattaaatgaggagtgagaagtccgaaacaggactcactgtataaataaacagctattttgttgaggaagggtaagataacggcgggtgcctgaagctttccggtttcaggtttactctgaggtctggaaagatgaagccccaggagatatttctatcaaccctggggctgccactccaaacccgaacaatttggatggtagtcccttcttcgcatggaggcaatataaacatgctgacgaaatatgcccttgcggcagtcatagtgctgtgtttaacggtgctgggatttacgcttctggtcggagactcgctgtgtgagtttacggtgaaggaacgtaatattgagtttaaggctgttctcgcttacgaaccgaagaagtagccgttgtgcggggagtaatcccataagcgctaacttaagggttgtggtattacgcctgatatgatttaacgtgccgatgaattactctcacgataactggtcagcaattctggcccatattggtaagcccgaagaactggatacttcggcacgtaatgccggggctctaacccgccgccgcgaaattcgtgatgctgcaactctgctacgtctggggctggcttacggccccggggggatgtcattacgtgaagtcactgcatgggctcagctccatgacgttgcaacattatctgacgtggctctcctgaagcggctgcggaatgccgccgactggtttggcatacttgccgcacaaacacttgctgtacgcgccgcagttacgggttgtacaagcggaaagagattgcgtcttgtcgatggaacagcaatcagtgcgcccgggggcggcagcgctgaatggcgactacatatgggatatgatcctcatacctgtcagttcactgattttgagctaaccgacagcagagacgctgaacggctggaccgatttgcgcaaacggcagacgagatacgcattgctgaccggggattcggttcgcgtcccgaatgtatccgctcacttgcttttggagaagctgattatatcgtccgggttcactggcgaggattgcgctggttaactgcagaaggaatgcgctttgacatgatgggttttctgcgcgggctggattgcggtaagaacggtgaaaccactgtaatgataggcaattcaggtaataaaaaagccggagctccctttccggcacgtctcattgccgtatcacttcctcccgaaaaagcattaatcagtaaaacccgactgctcagcgagaatcgtcgaaaaggacgagtagttcaggcggaaacgctggaagcagcgggccatgtgctattgctaacatcattaccggaagatgaatattcagcagagcaagtggctgattgttaccgtctgcgatggcaaattgaactggcttttaagcggctcaaaagtttgctgcacctggatgctttgcgtgcaaaggaacctgaactcgcgaaagcgtggatatttgctaatctactcgccgcatttttaattgacgacataatccagccatcgctggatttcccccccagaagtgccggatccgaaaagaagaactaactcgttgtggagaataacaaaaatggtcatctggagcttacaggtggccattcgtgggacagtatccctgacagcctacaaaacgcaattgaagaacgcgaggcatcgtcttaacgaggcaccgaggcgtcgcattcttcagatggttcaacccttaagttagcgcttatgggagtaatccccgcatatccggttgtcaggtcaggatggtaaggcacctgctttacactttcgcccgtggtcagtgatggctgcgggcgaatcgtaccagatgttgtcaattaatcgtgttggcacagcgttatgactatcttttcttttatctgccagtgcacagcaaacatctcattctcacgatgaatgatgacctgctgtttattccagctaattatctgatagtccagaaaacctgcatcagtttggatctcacttgccttaaatgcgctctctttggcggaaaatgccagtgtcagcgccagagaaaaggctaaaccgcagtctgcgagtcgctcgtgttccgctggtgtaataatgttgtctgtcaattctcttgcggtttgtacagaaaaaatttcttctatatcaatgccaatcggttgacgagataccacggctaatgccgtagtcccacagtggctaatactgccgtatacctccgcaggccagacaggttggcgtagctcgccgattgcgggcacacatttatagccatattcccgcaaagcataaacagcagcgatccgtccggctaaatgctctgttttacgtttacgtccagcgtgttgcagttgtgcgtagtgcggcagccagagtaaatcctgctcacaaaaattcgccggatcgaactcaacaaaatgcagcgtatgtccggcaaaggggagggaggtatgcgtagttttcatatcgaccatattcgagactgatgacaaacgcaaaactgcctgatgcgctacgcttatcaggcctacatggtcctgcaatatattgaattggcaagatttttgtaggccggataaggcgttcacgccgcatccggcatgaacgacgcgcactttgtcaacaatctgacgttagcatcagaagtgggtgtttacgctcatataccacgtacgtcccggctcgttataggtatacgccccggcaccggcgatatagttggcccctgccaaatcgcccgtggtctgggcattacccgcacgccacaaacgtttgtcgaacagattgtccacgccgccggtcagactgacattcttcgtcacatcccaggtcgcgctcaggccaacaatgctgtaaggactaatttctttggtttccggtccaaccgctggctgacctttatagttgtacttcttcggctgctgcttgccgtaccaggtgaaggtcgtttgcatcgacaaatcttcccgtgcctgccagctcagcgttgagttcaacgtatactccgggatgatcgacaaacggtcgcccgtggttttgttttcactcttcagcatataagtgatgttattggtccacatcaccgtttcgctaaccggtacgtttaacgatccttccagaccttcaaccaccgctttcggcacgttatcccactgatagagatcggtgccgactgcgttttgccctacagccacatagcccgcttcaatcttattgcgataatcgttacggaaccaggtgacgcccgccagccacccgtcgcgtttgaactccagaccaatctctttgttgatgctggtttctgctttcaggtcatcgttaccttgcagatagcagccgcccgcgctggcatagcaaccctgacctttactgtagagaatgtagttcgggttagtctggtacaggctcggcgctttataagcacgggcgatgcccattttcagcgtgaagtcatcgcctaaaccttgcgatatgttcagcgccgggctccagttattgccgacaatactgtgatgatcgaaacgcagccccggcgttacgatggtgctgtcagtcagctccatgttgttttcggcaaacagcgagaaaatttctgcttttgaatacgggctacggtcggtggtactcacgccatcaatagcgccaccggtattcgttccggtcagtgcctgggtgttggaacttaagtccttcatccgttgctgattccactccgtacccagcgtcagcgtctggttaacgaggaaatcaatcggcaggttaacttcgctgtgcagcatcacgtcatcaagatcgatatcgacgaaatcctgtgtcgctttttcgttaaatttcccttcggtaccgcccgccagaccttccggaatacgcgagttacgggtgtgttcgtactgcacccagttgctggtggtcacgccgttatcccagccaccgttccaggtcagcgcgtagttctggcgatacagacggttggtttcatcgccatatttcgagcgggtataggaatcggagttggtattctgggtgtcgcccgcatacaggttaccctggcggctgtaacctgcttccagttccagcgattgcaatggcgcgaaatcccagcgcaccacgccattaatatctttgttgattaccccttcgcgcccggctggtaacgtcgtggcatacgttccggcacgcgcggactgatggccctggttgatatcccacgcgtcagcctgggttttgtcgaggttgccatacaaacggaagctgaattcgtcgcccagcggaccggtcaggctaaagttagtgcgtttggtggcaccttcctctttatgttctggcgcattgaaatatgcgtcccaggagccgtgccactcgccgctgccttttttggtaatgatgttaaccacgccgcccgccgcgccgttgccataacgcgcagctgccggaccacgcagaacttcaatacgttcaatcatttcaggtggcacccaggaagtatcaccacgggtatcgcgctcgccacgccagccctgacgcaccgagttacggctgcttaccggcttgccgtcaatcaaaatcagcgtgttttccggacccataccgcgaatatcaatctgtcggttattcccacgctgaccactggtggagttaccggtcaggttaacgcctggcatggtacggatgatcttcgacacatcgcgggcaaccgggtttttgcggatttcatctgcggtgatggtcgaaacgccaggcgcctgtaagttctgctcggcggcggtaacgacaatagtatcgtcatgtgaaacaggagtatcggtcggctcttgtgcctgcgctaccccataaatccccagattgaccaacaaggccagggaatgaatcttcttgttcattgttttattcctgcatttttgccacgaattgcaactgtcgggcatggtcgtcatcaacacgacgcatcccgctaccgcgaaaacctttgatcctgaaagacacgcagtgcagttggttaattaatgtccgcgcttcccacggcgcgccattacgctattgcaaatgcaaatagttatcaataatattatcaatatatttctgcaatcaatgaaaaattgcacagtaaacatggggttatggtgtgacggcgttaaaagtaggaagtgagagctggtggcagtcgaaacatggcccggaatggcagcgtctgaatgacgaaatgtttgaggtcactttctggtggcgtgatccccaaggttctgaagaatactcgacgataaagcgcgtatgggtctacatcactggtgtgaccgatcaccatcagaacagccagccccagtcgatgcagcgaattgcaggcactaacgtctggcagtggacgacacaactcaatgccaactggcgcggcagctactgctttattcccaccgaacgcgatgacattttttctgtaccatcccccgatcgcctcgaattgcgcgaaggctggcgaaaactattaccccaggcgatagccgatccgctgaacctacaaagctggaaaggcgggcgagggcacgctgtttctgcactcgaaatgccgcaagcgcctctgcaaccgggatgggattgtccgcaagcgccagaaatacctgccaaagaaattatctggaaaagtgaacggttgaaaaagtcacggcgtgtatggatttttaccaccggcgatgcaacagcagaagaacgcccgctggcagttttgctcgatggcgaattttgggcgcaaagtatgcccgtctggccagtgctgacttcgctgacccatcgtcagcaacttcctcccgccgtgtatgtgttgatcgacgctatcgacaccacgcaccgcgcccacgaactgccgtgtaatgcggatttctggctcgcagtacagcaagagttattacccctggtgaaagctattgccccttttagcgatcgtgccgatcgcaccgtggttgccgggcagagttttggtgggctttccgcgctgtatgccggactgcactggcctgaacgctttggctgtgtattaagccagtcaggatcgtactggtggccgcatcggggcgggcagcaagagggcgtgttacttgaaaagctaaaagctggtgaagttagcgccgaaggtctgcgcattgtgctggaagcgggtattcgcgagccgatgatcatgcgggccaatcaggcgctgtatgcgcaattacaccccataaaagaatccattttctggcgtcaggttgacggcggacatgatgcgctttgttggcgcggtggcttgatgcaggggctaatcgacctctggcaaccacttttccatgacaggagttgaatatggcattcagtaatcccttcgatgatccgcagggagcgttttacatattgcgcaatgcgcaggggcaattcagtctgtggccgcaacaatgcgtcttaccggcaggctgggacattgtgtgtcagccgcagtcacaggcgtcctgccagcagtggctggaagcccactggcgtactctgacaccgacgaattttacccagttgcaggaggcacaatgagccagcatttacctttggtcgccgcacagcccggcatctggatggcagaaaaactgtcagaattaccctccgcctggagcgtggcgcattacgttgagttaaccggagaggttgattcgccattactggcccgcgcggtggttgccggactagcgcaagcagatacgctgcggatgcgttttacggaagataacggcgaagtctggcagtgggtcgatgatgcgctgacgttcgaactgccagaaattatcgacctacgaaccaacattgatccgcacggtactgcgcaggcattaatgcaggcggatttgcaacaagatctgcgcgtcgatagcggtaaaccactggtctttcatcagctgatacaggtggcggataaccgctggtactggtatcagcgttatcaccatttgctggtcgatggctttagtttcccggccattacccgccagatcgccaatatttactgcacatggctgcgtggcgaaccaacgcctgcttcgccatttacgcctttcgctgatgtagtggaagagtaccagcaataccgcgaaagcgaagcctggcagcgtgatgcggcattctgggcagaacagcgtcgtcaactgccgccgcccgcgtcactttctccggcacctttaccggggcgcagcgcctcggcagatattctgcgcctgaaactggaatttaccgacggggaattccgccagctggctacgcaactttcaggtgtgcagcgtaccgatttagcccttgcgctggcagccttgtggctggggcgattgtgcaatcgtatggactacgccgccggatttatctttatgcgtcgactgggctcggcggcgctgacggctaccggacccgtgctcaacgttttgccgttgggtattcacattgcggcgcaagaaacgctgccggaactggcaacccgactggcagcacaactgaaaaaaatgcgtcgtcatcaacgttacgatgccgaacaaattgtccgtgacagcgggcgagcggcaggtgatgaaccgctgtttggtccggtactcaatatcaaggtatttgattaccaactggatattcctgatgttcaggcgcaaacccataccctggcaaccggtccggttaatgaccttgaactggccctgttcccggatgtacacggtgatttgagtattgagatcctcgccaataaacagcgttacgatgagccaacgttaatccagcatgctgaacgcctgaaaatgctgattgcccagttcgccgcggatccggcgctgttgtgcggcgatgtcgatattatgctgccaggtgagtatgcgcagctggcgcagctcaacgccactcaggttgagattccagaaaccacgcttagcgcgctggtggcagaacaagcggcaaaaacaccggatgctccggcgctggcagatgcgcgttacctgttcagctatcgggaaatgcgcgagcaggtggtggcgctggcgaatctgctgcgtgagcgcggcgttaaaccaggggacagcgtggcggtggcactaccgcgctcggtctttttgaccctggcactccatgcgatagttgaagctggagcggcctggctaccgctggataccggctatccggacgatcgcctgaaaatgatgctggaagatgcgcgtccgtcgctgttaattaccaccgacgatcaactgccgcgctttagcgatgttcccaatttaacaagcctttgctataacgccccgcttacaccgcagggcagtgcgccgctgcaactttcacaaccgcatcacacggcttatatcatctttacctctggctccaccggcaggccgaaaggggtaatggtcgggcagacggctatcgtcaaccgcctgctttggatgcaaaatcattatccgcttacaggcgaagatgtcgttgcccaaaaaacgccgtgcagttttgatgtctcggtgtgggagtttttctggccgtttatcgcaggggcaaaactggtgatggctgaaccggaagcgcaccgcgacccgctcgctatgcagcaattctttgccgaatatggcgtaacgaccacgcactttgtgccgtcgatgctggcggcatttgttgcctcgctgacgccgcaaaccgctcgccagagttgcgcgacgttgaaacaggttttctgtagtggtgaggccttaccggctgatttatgccgcgaatggcaacagttaactggcgcgccgttgcataatctatatggcccgacggaagcggcggtagatgtcagctggtatccggcttttggcgaggaactggcacaggtgcgcggcagcagtgtgccgattggttatccggtatggaatacgggtctgcgtattcttgatgcgatgatgcatccggtgccgccgggtgtggcgggtgatctctatctcactggcattcaactggcgcagggctatctcggacgccccgatctgaccgccagccgctttattgccgatccttttgccccaggtgaacggatgtaccgtaccggagacgttgcccgctggctggataacggcgcggtggagtacctcgggcgcagtgatgatcagctaaaaattcgcgggcagcgtatcgaactgggcgaaatcgatcgcgtgatgcaggcgctgccggatgtcgaacaagccgttacccacgcctgtgtgattaaccaggcggctgccaccggtggtgatgcgcgtcaattggtgggctatctggtgtcgcaatcgggcctgccgttggataccagcgcattgcaggcgcagcttcgtgaaacattgccaccacatatggtaccggtggttctgctgcaacttccacagttaccacttagcgccaacggcaagctggatcgcaaagccttaccgttgcctgaactgaaggcacaagcgccagggcgtgcgccgaaagcgggcagtgaaacgattatcgccgcggcattctcgtcgttgctggggtgtgacgtgcaggatgccgatgctgatttcttcgcgcttggcggtcattcgctactggcaatgaaactggcagcgcagttaagtcggcaggttgcccgccaggtgacgccggggcaagtgatggtcgcgtcaactgtcgccaaactggcaacgattattgatgctgaagaagacagcacccggcgtatgggattcgaaaccattctgccgttgcgtgaaggtaatggcccgacgctgttttgtttccatcctgcgtccggttttgcctggcagttcagcgtgctctcgcgttatctcgatccacaatggtcgattatcggcattcagtcaccgcgccccaatggccccatgcagacggcggcaaacctggatgaagtctgcgaagcgcatctggcaacgttacttgaacaacaaccgcatggcccttattacctgctggggtattcccttggcggtacgctggcgcagggtattgcggcgcgactgcgtgcccgtggcgaacaggtggcatttcttggcttgctggatacctggccgccagaaacgcaaaactggcaggaaaaagaagctaatggtctggacccggaagtgctggcggagattaaccgcgaacgcgaggccttcctggcagcacagcagggaagtacttcaacggagttgtttaccaccattgaaggcaactacgctgatgctgtgcgcctgctgacgactgctcatagcgtaccgtttgacggtaaagcgacgctgtttgttgctgaacgcacacttcaggaaggtatgagtcccgaacgcgcctggtcgccgtggatagcggagctggatatctatcgtcaggattgtgcgcatgtggatattatctctccagggacgtttgaaaaaattgggccgattattcgcgcaacgctaaacaggtaaattaatattatttataaacccataattacagaaaataattatgggttttttatttgtttgatttataggtttgatgaatatttctcttaaatagagtgaatgttgcattcagtggaaggaatttacaaacttcagcttcggataattatcaccaactggtaaagtgagcgccgtggagatttccccctattggactcattttcaggttataccccatgtcatcactgaatattaaacagggaagtgacgctcattttcccgattatcctctggcgtcgcccagtaataatgaaattgatttacttaatctaatctcagttttatggcgggccaaaaaaacggtcatggcggtcgtttttgcgtttgcctgcgcaggcttgctgatctctttcatcctgccgcaaaaatggaccagcgcggcggttgtcacgcctccagaacctgttcagtggcaagagttggagaaatcattcactaagcttcgtgtgctggatctggatatcaaaattgatcgtacagaagcatttaacctgtttatcaagaagtttcagtcggttagcttgctggaagagtacctgcgttcatcaccttatgtgatggaccaattaaaagaggcgaaaatcgacgaactggatttgcatcgcgcaattgtcgcattgagcgaaaaaatgaaagcggttgatgacaatgccagtaagaaaaaagatgaaccgtcactgtatacctcctggacgctaagttttaccgcgccaaccagtgaagaggcgcagaccgttttgagcgggtatatcgattatatctctacgttggtggtgaaagagtcgctagaaaacgtccgtaataaactggagatcaaaacccagtttgaaaaagaaaaactggctcaggatcgcattaaaacgaaaaatcaacttgatgcaaacattcagcgcctcaattattcactcgacattgccaacgcggcaggaattaaaaagcccgtttacagtaatggtcaggccgttaaagatgaccccgatttttctatttctctcggtgcagacggtattgaacgcaaactggaaatagaaaaagcggtcactgacgttgcggaactgaacggtgaattacgtaatcggcagtatcttgtcgagcaattaacaaaagcacatgtcaacgatgtgaattttacgccgtttaaatatcagttaagcccgtcattgccagtgaaaaaagacggtccgggtaaggcgattattgtgatcctttccgcgttgatcggcgggatggtggcttgtggtggcgtgctgttgcgctatgcgatggcatccagaaaacaggatgccatgatggcagaccacttagtttaactatttgcggttgaaggtgccgttcgtccgagcggcaccacaagcggcgttccggcaactggatcgtcaatgatcatgcagcgcagaccataaatgcgctcaatcagttcagcagtgacaatctccttcggcgctccctgagcaacaattttcccttcccgcaatgcaatcaaatggctggcgtaacgacaggcctgattaagatcgtgcagcaccgccgccagggtatagcctttttcgcggttcagttcgcttaacaactccagcaaatcaatctgatgactgatatccagccaggtcgtgggttcgtcgagcagcataattgccgtttcctgggccagcaccatcgcgatccacgctcgctggcgttgtccgccagaaagggtatccacgctttgatctgccagatgagttattcccgtggcctgcattgctttcgttaccgcttcttcatcctctttgcgccagcgggtaaacagcggttgatgcggataacgtccacgcgccaccagctcctgcacggtgatatcgcccggcgtggtagcattttgcgccaacagaccaatccggcgtgcaacctctttactggcgtaatgttgaatgtgctcgccatccagccagacatgcccatgagcaggcgtcatcaggcggcttaaggtacgcagtaacgtggatttaccgcagccatttggcccgataattgccgtgaagtgaccatcaggtatttctacagtcagattttccgcaacggtatatttgccatatcccagggttaactgttcgccgcgcaaacgggctactgattcggtcattttttgcgagactcctgaattaacaagacgataaggtaaataccgccgaggctgacggtaacgacgccaaccggaagttgatacggcataaacagttgttgggcgcagagatcggccgccagcagtaacagcgccccgcatagcgccgcctgggttagcccccagcgagcggtgccgctaatgcgtcgggcaatgtgcggtgcgactaaagcaataaaggaaatcggcccggcaagcgctgttgccgcagcggtaagcaccactgcaaccagcatcattaacagacgcgaacgttcgacgctgacgcccagcgcacacgcggtatcatcgcccatttccagcaagcgcatccggcgtaccagtaaggcggcggcaatgagcatcaatataatgatgggtgcggaaggcgaggtttttgcccacgtcaggccgttgagcgatccggcattccacaaacctgctgttagcgccgtttctaaagacgctttcagcaacagccaggtattaaaggccaccagcatggcgcgaacgccgataccgataataatcaaccgaaaggtgtcgatgccgttgcgccaggcgagcagccagaccagcagcgaagtgacaatgccgcccaccattgctgacagcgcgatagccgtcaggtcctgaccaaacagcaccatcgccaccagcacgccgctccacgccccggtgttaaagcccattacgtcagggctgccgagcgggttacgcatcagcgactgaaaaatcgcgccactgacgcccagtgctgcgccaatcaacagcgccatcagcacgcgtggtaaacgccattcggtgaccaccatcgtcatactgcgcggcgcatcgcccatcagcgcggcgaatacctgcgaggtttccagcgtgacggcaccgctgcgtaatccccagatacctgcaaccacacaggcggaaaccagcagcaaacaggtgatgagtaatcggcgagagacgtaaatcatgcaccacctcgcgttttacgtcgcacgaggaagatcagcaccggtgcaccaataaacgcactgaccacagaaacgcgcagttcgccgggcacaatcacccgcccgatgatatcggcaaacagcagcagggcaggggtagcaagtagcgtgacgggcagcgaccagcgatgatcggcacccaccagccaacgcgccatatgcggcatcatcaggccaataaaggcaatcgggccaactattgccgtcgcactaccacaaagcacggtaatcgccagcagaccaatcaactgtgtgcgcgccacgcgactgcccagcgccgtcgcggtgtcgctgccgaggctcaaactgttcagcgcgcgactcagtaatagcgcagttgctccggcgatcagcaccgggatcagcaccacttttaaggtatgtagattgcgaatatccagcgaaccggcttgccagaaacgcaactgatcgtagacgtcaggattaagcagggcgatgccgctggtcagtccttccagcaccgccgccagcgccacgcccgccagggttaaacgcaccggacttaactgcccgccgccctgactgccggtaaaggcaacaatcaatgaggccaccagcgccccggcgaaggccatcgccagttgttcctgcgcggaagagtaaccaaacagcgccgcacccagcacaatggcaaagctggctccggcgttcacgccaagcaagccggggtcggcaagtgggtttcgggtgagggtttgcattaacgccccggcaaggccaagcgcgccgcctgccagtaaaccggcaagggtacgcggcagccgcgcgtcgagcacgatggtgcagtcggcgctctggcaggtgccggagaaggcctccagcactacggaagcggggagtgattttgccccaatgagcaggcttaatgccgtcgcgataatcagtaataacagcaatccgggcacggcaatggcgcgtgtcacggcaacagaaccagacatacgaacttccatgataatgaaattaattatcgttatcgatcttatttggatatgttagcatgtgcagcctaagaataggtatttaaaatatttgatggcaaggcattgtaatgaataaacaatcctggctgcttaacctcagcctgttgaaaacgcacccggcgtttcgcgcagtattcctcgctcgtttcatctcaattgtgtctctgggtttgctcggcgtcgcggtgccggtgcagatccagatgatgacacattccacctggcaggtggggctttcggtgacgctgaccggcggcgcgatgtttgttggcctgatggtcggcggtgtgctggcggatcgctatgagcgcaaaaaagtgattttgctggcgcgcggcacctgtggcattggcttcattggactgtgccttaatgcactgctgccggagccgtcattgctggcaatctatttacttggtttatgggatggttttttcgcatcgcttggcgttacggcgctattggcggcgacaccagcactggtagggcgtgaaaacttaatgcaggccggggcgatcaccatgttgaccgtgcgtctggggtcggtgatttcgcccatgattggcggtttattgctggcgaccggtggcgtagcctggaactacgggctggcggcggcgggcacgtttattaccttgctaccgttgttaagccttccggcgttgccaccgccaccgcagccgcgtgagcatccgttgaaatcattactggcaggatttcgttttctgcttgccagcccgctggtgggcgggattgcgctgctgggtggtttattgacgatggcgagcgcggtgcgggtactgtatccggcgctggctgacaactggcagatgtcagcggcacagattggttttctctacgcggcgatcccgctcggcgcggctattggtgcgttaaccagcgggaagctggcacatagtgcgcgaccagggttattgatgctgctctccacgctgggatcgttcctcgccattggtctgtttggcctgatgccgatgtggattttaggcgtggtttgtctggcgctgttcggctggttgagtgcggtcagctcgttgctgcaatacacaatgctgcaaacgcaaaccccggaagcgatgttagggcggattaacggtttgtggacggcgcagaacgtgacgggcgatgccataggcgcggcgctgctgggtggtttgggcgcgatgatgacaccggttgcttccgcaagcgcgagcggttttggtttgttgattatcggcgtgttgttattgctggtgctggtggagttgcgacattttcgccagacgccgccgcaggtgacagcgtccgacagttaatgcttaaaacagcgccttaagcctatccagcacttgcatggcgctgtagtaatccagacggaacgtctcggttcccagcgcataaacctgcttgttttgtactgcaggcaggtgcgcgagcagcggattagcataaatagcatcggcatctttctgatcaccggcgaacaggaatagtgactcgccatttaaccctgcagccagattttccccaccaagctgaatgatgtcatggcgtttaccctgactttggctggcatttaaccctgcgggtaacttcgccagcgtaaagccgagttgttccagcatctgcccttgtgctgattctggcgtccagagattggcactgtgtgcagcggcagtatagacaatggcagtgaccggctgcggcggtaatttgatttgctctttcgccgccgccagttgcttatcaaactgcgcaatccgctctgccgcttgtttctcatgcccggtaatttcgccaagttgcgttaacagcgactgccagcttttgtcgtcgtaattgatgattaatgtcggggcgatggtggaaagctgatcatacagtgccagcgccgaatccccgccggttgcgctaattaaaatcagatccggcatttgcgcggcaacggcttcggcgctcggttcgccgatatagagccgttgcagtttgcgttctttcgccaccttgctccactggcgtaaaaagccctggtcatccgcgacgcggttattcggcgtggtcgcgccgctggcgatcaccggagcatcaatcgccagcagtgagccggtcagggtgacgctggtggaaacaatacgctgcggctggctttccagtgtatgtgtgccacggctgtcagtaatctgacgcggccagtcagcggcctgaactgcggctattcctgaaagcaaaagtcctgttaatagaagggcgttgcggtagagcggggcgagtctcacaaatcagcttcctgttattaataaggttaagggcgtaatgacaaattcgacaaagcgcacaatccgtcccctcgcccctttggggagagggttagggtgaggggaacagccagcactggtgcgaacattaaccctcaccccagccctcaccctggaagggagagggggcagaacggcgcaggacatcacattgcgcttatgcgaatccatcaataatgcttctcattttcattgtaaccacaaccagatgcaaccccgagttgcagattgcgttacctcaagagttgacatagtgcgcgtttgcttttaggttagcgaccgaaaatataaatgataatcattattaaagcctttatcattttgtggaggatgatatggatacgtcactggctgaggaagtacagcagaccatggcaacacttgcgcccaatcgctttttctttatgtcgccgtaccgcagttttacgacgtcaggatgtttcgcccgcttcgatgaaccggctgtgaacggggattcgcccgacagtcccttccagcaaaaactcgccgcgctgtttgccgatgccaaagcgcagggcatcaaaaatccggtgatggtcggggcgattcccttcgatccacgtcagccttcgtcgctgtatattcctgaatcctggcagtcgttctcccgtcaggaaaaacaagcttccgcacgccgtttcacccgcagccagtcgctgaatgtggtggaacgccaggcaattccggagcaaaccacgtttgaacagatggttgcccgcgccgccgcacttaccgccacgccgcaggtcgacaaagtggtgttgtcacggttgattgatatcaccactgacgccgccattgatagtggcgtattgctggaacggttgattgcgcaaaacccggttagttacaacttccatgttccgctggctgatggtggcgtcctgctgggggccagcccggaactgctgctacgtaaagacggcgagcgttttagctccattccgttagccggttccgcgcgtcgtcagccggatgaagtgctcgatcgcgaagcaggtaatcgtctgctggcgtcagaaaaagatcgccatgaacatgaactggtgactcaggcgatgaaagaggtactgcgcgaacgcagtagtgagttacacgttccttcttctccacagctgatcaccacgccgacgctgtggcatctcgcaactccctttgaaggtaaagcgaattcgcaagaaaacgcactgactctggcctgtctgctgcatccgacccccgcgctgagcggtttcccgcatcaggccgcgacccaggttattgctgaactggaaccgttcgaccgcgaactgtttggcggcattgtgggttggtgtgacagcgaaggtaacggcgaatgggtggtgaccatccgctgcgcgaagctgcgggaaaatcaggtgcgtctgtttgccggagcggggattgtgcctgcgtcgtcaccgttgggtgagtggcgcgaaacaggcgtcaaactttctaccatgttgaacgtttttggattgcattaaggagcgaggatgagcattccattcacccgctggccggaagagtttgcccgtcgctatcgggaaaaaggctactggcaggatttgccgctgaccgacattctgacgcgacatgctgcgagtgacagcatcgcggttatcgacggcgagcgacagttgagttatcgggagctgaatcaggcggcggataacctcgcgtgtagtttacgccgtcagggcattaaacctggtgaaaccgcgctggtacaactgggtaacgtcgctgaattgtatattacctttttcgcgctgctgaaactgggcgttgcgccggtgctggcgttgttcagccatcagcgtagtgaactgaacgcctatgccagccagattgaacccgcattgctgattgccgatcgccaacatgcgctgtttagcggggatgatttcctcaatactttcgtcacagaacattcctccattcgcgtggtgcaactgctcaacgacagcggtgagcataacttgcaggatgcgattaaccatccggctgaggattttactgccacgccatcacctgctgatgaagtggcctatttccagctttccggtggcaccaccggcacaccgaaactgatcccgcgcactcataacgactactactacagcgtgcgtcgtagcgtcgagatttgtcagttcacacaacagacacgctacctgtgcgcgatcccggcggctcataactacgccatgagttcgccaggatcgctgggcgtctttcttgccggaggaacggttgttctggcggccgatcccagcgccacgctctgtttcccattgattgaaaaacatcaggttaacgttaccgcgctggtgccacccgcagtcagcctgtggttgcaggcgctgatcgaaggcgaaagccgggcgcagcttgcctcgctgaaactgttacaggtcggcggcgcacgtctttctgccacccttgcggcgcgtattcccgctgagattggctgtcagttgcagcaggtgtttggcatggcggaagggctggtgaactacacccgacttgatgatagcgcggagaaaattatccatacccagggttacccaatgtgtccggatgacgaagtatgggttgccgatgccgaaggaaatccactgccgcaaggggaagtcggacgcctgatgacgcgcgggccgtacaccttccgcggctattacaaaagtccacagcacaatgccagcgcctttgatgccaacggtttttactgttccggcgatctgatctctattgatccagagggttacatcaccgtgcaggggcgcgagaaagatcagattaaccgtggcggcgagaagatcgctgccgaagagatcgaaaacctgctgctgcgccacccggcggtgatctacgccgcactggtgagcatggaagatgagctgatgggcgaaaaaagctgcgcttatctggtggtaaaagagccgctgcgcgcggtgcaggtgcgtcgtttcctgcgtgaacagggtattgccgaatttaaattaccggatcgcgtggagtgtgtggattcacttccgctgacggcggtcgggaaagtcgataaaaaacaattacgtcagtggctggcgtcacgcgcatcagcctgaaggagagaacacgatggctattccaaaattacaggcttacgcactgccggagtctcacgatattccgcagaataaagttgactgggcctttgaaccgcaacgtgccgcgttgttaatccatgatatgcaggactattttgtcagcttctggggcgagaactgcccgatgatggagcaggtgatcgcgaatattgctgcgctgcgcgactactgcaaacagcacaatatcccggtttattacaccgcccagccgaaagagcagagcgatgaagatcgggcgctgttgaatgatatgtgggggccgggcctgacccgctcgccggaacagcaaaaggtggtggatcgcctgacgccagatgccgacgacacggtgctggtgaagtggcgctacagcgcgtttcatcgttctccgctggagcaaatgctgaaagagagtggacgtaaccagctgattattaccggggtatatgcccacattggctgtatgaccaccgcaaccgacgcatttatgcgcgatattaaaccgtttatggtggcggatgcgctggccgatttcagccgtgacgagcatttgatgtcgctgaaatatgtggccggacgttctggccgggtggtgatgactgaagaattactgccagcacctatccccgccagcaaagcggcgctgcgtgaggtgatcctgccgttgctggacgagtccgatgaaccgttcgatgacgacaacctgatcgactacggtctggattcggtgcgcatgatggcgctggcggcgcgctggcgcaaagtgcatggtgatatcgactttgtcatgctggcgaaaaacccgaccatcgacgcctggtggaagctactctcccgcgaggtgaaataatggatttcagcggtaaaaatgtctgggtaaccggcgcaggtaaaggtatcggctacgccacggcgctggcgtttgttgaggcgggagcgaaagttacaggttttgatcaagcgttcactcaggagcaatatccctttgcgaccgaagtgatggatgttgccgacgctgcgcaggtcgcgcaagtgtgtcagcgactgttagctgaaacggagcgactggacgcgctggtcaatgcggcgggaattttacgcatgggcgcgaccgatcagctcagtaaagaggactggcagcagacttttgcggttaacgtcggcggtgcgtttaacctgttccagcaaaccatgaaccagtttcgccgtcagcggggcggggcgattgtcactgtggcgtccgacgccgcgcacacgccgcgtattggcatgagtgcttatggcgcatcgaaagcggcgctgaaaagcctggcgttgagcgtcgggctggaactggcgggtagcggcgtgcgctgtaatgtggtttcgcctggctccaccgacaccgatatgcaacgcacgctgtgggtgagcgatgacgccgaagaacagcgtattcgcggctttggcgagcagtttaaactcggcattccgctggggaaaatcgcccgtccacaagagatcgccaacacgattttgttcctcgcctctgacctcgccagccatattaccctacaggatattgtggtcgatggcggctcaacgctgggggcataagcatgatctggaaacgccatttaacgctcgacgaactgaacgccaccagcgataacacaatggtggcgcatctgggaattgtgtatacccgtctgggcgatgatgtgctggaagccgaaatgccggttgatacccgtactcatcagccgttcggtttactacatggcggcgcgtcggcggcgctggcggaaacgctgggatcgatggccggatttatgatgacccgcgacggacagtgtgtggtaggcacagaacttaatgcaacacaccatcgcccggtgtctgagggaaaggtacgcggcgtctgccagccgctgcatcttggtcggcaaaatcagagctgggaaatcgtcgttttcgatgaacaggggcggcgttgctgcacttgtcggctgggtacggcagttttgggatgaacccgacagaattagatgagattgcaggaaaactcggttaacggagtgatcgagttaacattgttaagttaaatattggtttcaactccgatttacatggttgctgtgttgttaaattgtacaaagatgttatagaaacaaaatgtaacatctctatggacacgcacacggataacaactatgaacaaatcagggaaatacctcgtctggacagtgctctctgtaatgggagcatttgctctgggatacattgctttaaatcgtggggaacagatcaacgcgctgtggattgtggtggcgtcggtctgtatctatctgatcgcttaccgtttttatgggctgtatatcgccaaaaatgtgctggcggttgacccgacgcgtatgacgccagcggtgcgccataacgacgggctggactatgtgccgacggacaagaaagtgctgttcggtcaccattttgcggccattgccggagcaggtccgctggtggggccggtactggcggcgcaaatgggctacctgccggggatgatctggctgctcgctggggtggttctcgccggtgcggtgcaggatttcatggtgctgtttgtttctacgcgccgtgacggtcgctcgctgggtgagctggtcaaagaagagatggggccaaccgccggggtgattgcgctggtggcctgctttatgatcatggtcattatccttgcagtgctggcgatgatcgtggtgaaagccctgactcatagcccgtggggaacatataccgttgcgttcaccattccgctggcgctgtttatggggatctacctgcgctatctgcgtccggggcgtattggcgaagtgtcggtcatcggtctggtattcctgattttcgccattatctctggcggctgggtggcagaaagtccgacctgggcaccgtactttgactttaccggcgtgcagttgacctggatgctggtgggttacggttttgtggcggcggtgctgccggtgtggttactgctggccccgcgtgactacctctctaccttcctgaaaatcgggactatcgtcggtctggcggtaggcattttgattatgcgcccgacgctgaccatgcctgcgctgaccaaatttgtcgatggcactggcccggtatggaccggtaacctgttcccgttcctgtttatcaccatcgcctgtggcgcggtgtctggcttccatgcgctgatctcttctgggaccacgccgaagatgctggcgaacgaagggcaggcgtgctttatcggctacggtgggatgttaatggaatccttcgtggcgattatggcgctggtttccgcctgtatcatcgatccgggcgtgtattttgccatgaacagcccgatggcggtgctggctccggcagggacggcggatgtggtcgcttctgccgcgcaggtggtgagtagctggggctttagcattacaccagatacgctaaaccagattgccagcgaagtgggtgaacagtcgatcatttcccgtgcgggcggtgcgccgacgctggcggtggggatggcctacattctgcacggcgcgctgggcggcatgatggatgtggcgttctggtatcacttcgccattttgtttgaagcactgtttattctgacggcggtggatgcaggtacgcgtgctgcgcgctttatgttgcaggatctgctgggcgtggtgtctcctggcctgaagcggaccgattcactgcctgctaacctgctggcaacagcgctgtgcgtactggcgtggggctacttcctccatcagggcgtggtcgatccgctgggcggcattaacactctgtggccgctgtttggtattgccaaccagatgctggcagggatggcgctgatgctctgtgccgtggtgttgttcaagatgaaacgtcaacgttacgcctgggtggcgctggtaccaacggcctggctgctgatttgtaccctgaccgcaggctggcagaaagcgtttagcccggatgcgaaagtcggcttcctggccattgctaataagttccaggcaatgatcgacagcggcaatattccgtcgcagtatactgagtcacagctggcgcaactggtgttcaacaaccgtctggatgccgggttaaccatcttctttatggtggtcgtggtggttctggcactgttctcgattaagacggcacttgcggcattgaaagatccgaagccaacggcgaaagaaacgccgtatgaaccaatgccggaaaatgtcgaggagatcgtggcgcaggcaaaaggcgcacactaaagtcagagtgagggggggatgttggcgaatgttggcttagtgcccagggttccctctcaccctaaccctctccccggtggggcgaggggactgaccgagcgcgttgatagcatttgtaggccggataaggcgttcacgccgcatccggcactctttcagcaacatggttagcggaggccaagatgtttgattcactggcaaaagccggaaaatatttaggtcaggcggcgaagctgatgattggtatgcctgattacgacaactatgtcgaacatatgcgggttaaccatcccgatcaaacgccgatgacctacgaagagtttttccgtgagcggcaggacgcgcgctacggtggaaaaggcggcgcgcgctgctgctaaatttgtacgtcaggctttaaacgattccacttttttgaacgctgcacgcaacgtatctggtgtcagcgtgactggcaggtaatgaatggactccaccggacgcagggtgtgggcaatcactttgtcgatctccgcctgattattgatatccacttccagctccgccagtgtagtcggcagatgaaaacgctgatacgctccagttaattgcgccagcacatcatcctgacccagcaaggcgctttgcaccagaattccgtaggcgactttggtgccgtggagaaacttctcggtttgcggcagcacggtcagaccgttatgcacggcatgagctgccgccacacgcgtaaaacgatcgcccagaccaccaaccatcccaccaccagcaataatagcatccaccacatcgcaaaatgattgcgttaactgttgattttgctgatcgctcagcgcctgttcgctactgtttaacaagacgtcgcgaatggcttgcgcattattgatccccagtcgcacggttagcggcaacgtttctggttgcggagccagcaccaccgcttcataccatttcgccagcgtgtcaccgatccccgccagcagatattgttgcggtgcattgaggataatctccggttccaccagcaccataaaattggcgtcgtcgaaaatctcataatgcagcgcctgtccggcatcattataccagacggagagcggtgtccaggcggcgcaggtggcggcgatcgtcggaacggcaacaaacggcagaccgagacggcgggcgagggctttcgcggtgtcgagcagtgcaccgccaccgacgccaatcaccacgctgcggtcgtcaccggactcagccgccagttgttgtacatcgctttcgctgcaatgaccgcgaaacaaaatatgctttgcccctggcagtccaaacgctggcggaagtttggtttgcgccgcagcaatggcgcgtttgccgtagatccacaccgcgcgagaaagttgttcatcagtgaaaaaatcgtgcaggtgattgaaacttcctggatgtgaaaagtagttagccgggccgacgaccacgcggataggattgtgaggcatgttgtgttgtccttattgttttatttagacatctaaacgtcttgattgccaaatactagcatcgtgttatagtgccttcaacacgcaacttcgtcaggtacaataaaaatgacaaataaccctctgattccacaaagcaaacttccacaacttggcaccactattttcacccagatgagcgcgctggcgcagcaacaccaggcgattaacctgtcgcaaggctttcctgattttgatggtccgcgctatttacaggagcggctggcgcaccacgttgcacagggggcaaaccaatacgcgcccatgaccggcgtgcaggccttgcgcgaggcgattgctcagaaaacggaacgtttgtatggctatcaaccagatgccgatagcgatatcaccgtaacggcaggggcgacggaagcgttatacgcggcgattaccgcactggtgcgcaatggcgatgaagtgatttgttttgatcccagctatgacagttacgcccccgccatcgcgctttctgggggaatagtgaagcgtatggcactgcaaccaccgcattttcgcgttgactggcaggaatttgccgcattattaagcgagcgcaccagactggtgatcctcaacactccgcataaccccagtgcaactgtctggcagcaggctgatttcgccgctttgtggcaggcgatcgccgggcacgagatttttgtcattagcgatgaagtctacgagcacatcaacttttcacaacagggccatgccagtgtgctggcgcatccgcagctgcgtgagcgggcagtggcggtttcttcatttggcaagacctatcatatgaccggctggaaagtgggttattgtgttgcgccagcgcccatcagcgccgaaattcgcaaggtacatcagtatctgaccttttcggtgaataccccggcacagctggcgcttgctgatatgctacgtgcagaacctgagcattatcttgcgttaccggacttttatcgccagaagcgcgatattctggtgaatgctttaaatgaaagccggctggagattttaccgtgtgaaggtacatactttttgctggtggattacagcgcggtttctaccctggatgatgttgagttttgccagtggctgacgcaggagcacggcgtagcggcgattccgctgtcggtgttttgcgccgatcccttcccacataaactgattcgtctctgttttgccaagaaggaatcgacgttgctggcagcagctgaacgcctgcgccagctttagctatttaaccgtccaggcgcgggaatattgacggtcggcaaacaactcttgcaggccgttaatttgcttcaggcgcagcacttcgtcgctgtccattcccagctctttgccaattttattatcgtcccatcccaactggctaagttcacggacgatttccgacatggcggtgatttgatggcgtccacgagcgcgattatgacgaatagtcgcggcgatgcgttgattacgcgtaccttccagacaggtcaccggcaaataaccttttaagcgtaattttaatgatgatgagcctttaccaatttcatggcggtgaaaaccatccacgatttccatggcatttttatccgtatgtgtgaccacaatgggttgggtaaaaccatctatttcaatggatttttgcagcagttttttttcgggtggtgccacgttgtttgggttgtaatcattaggcataagttggctgtttttaacccacagaacgcaatccactggctcttcacgaaaggggctaacctgatggatcgccatgcggatttcattaatcgctttgatgcgatcatcttccggcaagctggcgagaaattgcgttaaatcctgcgttaatcgttgttgcatagtatcccccattcctgacgttttccttttatccgttcgttataacgctgatagttcttcgattttgtggggctaaatgataatgcccgacaccagtaatcgttattgagtaaaactttgcatatccgccgccaggaggggatatctttcgcgccaatgtccccttgctgggtttgtggaacctcgatgccttttttctgataccagtgcaaataaatggcgattttattgcggtaatgctcagctgttttttccggcatgctattgagcagcaataatgcatattcttgccagtctaaatgttctggcttgaggattttccgatgcccatagaaatgattgtcatgtccggcgtaaatgccgccactttttaccccgctgactcgtgcgcacatagcagcccagcgatccggttcgataacgtgatagagccataatccttgtcgttgctccgggccaaaaggttcgcaaattcgcatatgacgcagaggaacgcctgcctgatacattaggttatacagtgggttgcagagactttgatgatttgcataccaggtccagatatcagccactttccagtcgtaaatggggtaaatgtaccagctatgaccgcctggtgcggccgtagtccagggtttatcgtcggcaaaacgttgtttatttaaactggcgatggcgacaaaacggttgtaggactcatccgcacggatgccgatcatcatcgccgccggacgtttttgtgaaaaccattcggcaaactcacgtacaaattgttcgaaggtcatgcctggctggtaaaagcagaaaaagtcagggtcggttatcgcatcttggggaggttgacgtacccattcgacatcaggttcccagcactgccattcgggttggtattgtgaaagggaattttgcgtcgtaagcgggagcgcaacccagtaaaactcttcgatgacatcggtgtacaactcgcgcagggactgaacatagttaatggtgcaagagaattgcgcctcccagtcgataaacaaaacgcagatttttttgcccatttgtcgggcaagttcggctgtcagatgcagcattaaaccagagtctttgccgccagaaaatgagacacaaacgcggggtagggtgttgagtgtccaggtaatacgctctcgtgcagcttccagaatattgagcggaagaggaattttataaatagacatctgaagacgctctctgaacgttacagggtgatcagtgagataagtctgttaattataaagtaaacactgtaaagcagagtgttttatttttcattcgcgctgtgaataaatagatgaaagttatagtagctgtctgtagttatatatcaaaaactctcatttagacggtcaataaatcgggagaacaccaaattatttaaagaagatttattataggaaatgtaaagctttattgaaggtaacggatgttctagttttatctcttttaagttaagaaagtcacggtaggaattataaagttcataggggactattcccagtaaatctgtaactgcaatgctattaatgattgtcagcaaagaggaaccacgaaatgagattttgcgattcataaatctctcgtctatttccatttgaatatcatcaacccctgctgatttagatattaattgggtgaactcttctgccataatttgttcataagtgctattgtcagtaattcgtggatgcctattactacaaattagagtattgcgaatcgtatgcaatggcatgcaaatgacggaacggctgatcactggcatttgggtgatcaccagatcggctttgcggtgaaccaacagttcttcagcattctctgctgacatgaggatatcatggcactcaatctcgacagaggaatcttgccgtaggcagcggatcagcatactattattagagcaagaaatgagctgagggccgtagataataaagtttttctttagttcggacttattgactatattaattgtttgttcaaggcctctgagatttttctcaagatggtgatgcagatttaaccctgttgtcgtcggcgcgataccttttcctgagcgaatgaataaagggtcattaaattgcgcacgtaagcgttgtaacgactggctcacggctgatggggtgatatatagtgattcagcagctttgctaatgcttaaatgctggtaaatacactcaaatatgacaagaagatttaagtcgaactttttcaagtcgtagagattggccatacactactccggttatatttttcttccatgatatattcacttaatcaatgttttttgcgtatatatttttattgattatgtttttttgcttaactcaggattaagtttttctaaaatagcacagccacttagggcagagcgagcaattcatgcttttttaggatggttgaaaagcagggatatagttcaaccatccatgaattaccttttatttattccccataatgatattaagcgttttctgatcgggcaaccccacggcctgttgtagcgtattttccttactcatgtaatagatagccggcgtgacatttgcccccagatcgtccatcagtttctcattgtcacttaacactttcatttgctctgtacttacgtttgcaggcacgtttagcttaagcttgccaccagaggcttcatattgttgccaggtttttgcgggatctttggaggcaagaattgccgctgctgtcgccgggctttctggcttgataaccccaaccaacaatgttcttaattgcactttgccagaatctacccacgggcgcgcctgctgccagaactgtttacaatatgggcagaacggatcggcgaagacgtagacaatgaccggcgcatcttttttaccgtcgaggagccagtgggattgttccatccgttgccacatttcgcgtccggctggtgcgtaaatttctttttcgataagtgtgttactcaggttttcacctttctcgttgtacatgtaaccagagatagcgtgcttaccatctggagtcaggtagatggtgacgcccatatcctgatactttccgagataacctttcattcctccgggggcatcgaatgttttgatgattgtaatgccctgtttttcaatcgcttttactggagcaggaagttcctctgcgaaggcgattgcaggaagcagagccagtaaaagtatcttttttaacattaatttgtccttttcagtcagtgcaaaagtcgagtaaaaggcataacctatcactgtcataggtaagagcttagatcaggtgattgccctttgtttatgagggtgttgtaatccatgtcgttgttgcatttgtaagggcaacacctcagcctgcaggcaggcactgaagataccaaagggtagttcagattacacggtcacctggaaagggggccattttactttttatcgccgctggcggtgcaaagttcacaaagttgtcttacgaaggttgtaaggtaaaacttatcgatttgataatggaaacgcattagccgaatcggcaaaaattggttaccttacatctcatcgaaaacacggaggaagtatagatgtccttgattaacaccaaaattaaaccttttaaaaaccaggcattcaaaaacggcgaattcatcgaaatcaccgaaaaagataccgaaggccgctggagcgtcttcttcttctacccggctgactttactttcgtatgcccgaccgaactgggtgacgttgctgaccactacgaagaactgcagaaactgggcgtagacgtatacgcagtatctaccgatactcacttcacccacaaagcatggcacagcagctctgaaaccatcgctaaaatcaaatatgcgatgatcggcgacccgactggcgccctgacccgtaacttcgacaacatgcgtgaagatgaaggtctggctgaccgtgcgaccttcgttgttgacccgcagggtatcatccaggcaatcgaagttaccgctgaaggcattggccgtgacgcgtctgacctgctgcgtaaaatcaaagcagcacagtacgtagcttctcacccaggtgaagtttgcccggctaaatggaaagaaggtgaagcaactctggctccgtctctggacctggttggtaaaatctaaatttccttcgtctttcacgccatagcggcgttggcgtcgcccgctcaccccggtcacttacttgtgtaagctcccggggattcacaggctagccgccttgctctgacgcgaaatacttcggaaattcacctaattcttcgggtgctgcggcacccgattttcttccccgcaccatgatgcaagctgcatccaggtagccgcagaggccgcttgcatgatgatgtttaaagcccaggagataaacatgctcgacacaaatatgaaaactcaactcaaggcttaccttgagaaattgaccaagcctgttgagttaattgccacgctggatgacagcgctaaatcggcagaaatcaaggaactgttggctgaaatcgcagaactgtcagacaaagtcacctttaaagaagataacagcttgccggtgcgtaagccgtctttcctgatcaccaacccaggttccaaccaggggccacgttttgcaggctccccgctgggccacgagttcacctcgctggtactggcgttgctgtggaccggtggtcatccgtcgaaagaagcgcagtctctgctggagcagattcgccatattgacggtgattttgaattcgaaacctattactcgctctcttgccacaactgcccggacgtggtgcaggcgctgaacctgatgagcgtactgaacccgcgcatcaagcacactgcaattgacggcggcaccttccagaacgaaatcaccgatcgcaacgtgatgggcgttccggcagtgttcgtaaacgggaaagagtttggtcagggccgcatgacgttgactgaaatcgttgccaaaattgatactggcgcggaaaaacgtgcggcagaagagctgaacaagcgtgatgcttatgacgtattaatcgtcggttccggcccggcgggtgcagcggcagcaatttactccgcacgtaaaggcatccgtaccggtctgatgggcgaacgttttggtggtcagatcctcgataccgttgatatcgaaaactacatttctgtaccgaagactgaagggcagaagctggcaggcgcactgaaagttcacgttgatgaatacgacgttgatgtgatcgacagccagagcgccagcaaactgatcccagcagcagttgaaggtggtctgcatcagattgaaacagcttctggcgcggtactgaaagcacgcagcattatcgtggcgaccggtgcaaaatggcgcaacatgaacgttccgggcgaagatcagtatcgcaccaaaggcgtgacctactgcccgcactgcgacggcccgctgtttaaaggtaaacgcgtagcggttatcggcggcggtaactccggcgtggaagcggcaattgacctggcgggtatcgttgagcacgtaacgctgctggaatttgcgccagaaatgaaagccgaccaggttctgcaggacaaactgcgcagcctgaaaaacgtcgacattattctgaatgcgcaaaccacggaagtgaaaggcgacggcagcaaagtcgttggtctggaatatcgagatcgtgtcagcggcgatattcacaacatcgaactggccggtattttcgtccagattggtctgctgccgaacaccaactggctcgaaggcgcagtcgaacgtaaccgcatgggcgagattatcattgatgcgaaatgcgaaaccaacgtgaaaggcgtgttcgcagcgggtgactgtacgacggttccgtacaagcagatcatcatcgccactggcgaaggtgccaaagcctctctgagtgcttttgactacctgattcgcaccaaaactgcataagaagaagtaagattcacctgcaattgcttagccgccggggtcaaacctggcggcttttttatggcattaaaaagccccgccgggatggctccgggcagggcgggatacttattctggcaattaacgcacaaccagcaccggcagattggcgtggcggatcacgctcgaggcgttagaacctaacagatgggtcgaaatcgatgggttgcgagaaccaataactacaacatcagcccccagttcttctgccaactcattgacttcatcccgcacgctaccaaaacggacatgttgtttaatgcgggaaggatcgatggtgaagtggctgaccatcgtttgcagacgttcttgtgcttcatgttgcagatgctcttcaaaacgacgcacatcagcggcaaaacggtgcaggctcaggctggctgacccgggtagtacgtgaagtagatgaataactccgtcatcctgggcgaggaattcagcgtggcgaacagctttgtcgctcaattccatttcaaatacatcaactggcataatgattgtcttatacataaccctttctccctgttaatcatgaacaaatcattcgccatgattataatatttatccctgatatttgtctggttctttttccttacgaactgtttctgtgatgaatatattctcactgaacaccaggaattctcccaaaacctgtggtaccgcccgttttcccgctgtgatagctacccttaaagactgactcttttttgaactgtctctggaggttgcatgaaagcattgacttatcacggcccacatcacgttcaggtagaaaatgttcccgatccgggcgttgaacaggcagatgatattattctgcgtattacggcaacggcgatctgtggctctgacctccatctttatcgaggcaaaatacctcaggttaaacatggcgatatttttggtcatgaatttatgggggaagtagttgaaaccggaaaggacgtaaaaaatttgcaaaaaggcgaccgagtggtaattccgttcgtcattgcttgtggcgactgttttttctgtcgattgcaacaatatgccgcctgcgaaaataccaatgcgggtaaaggcgctgcgctcaataaaaaacagataccagctccagcggcattgtttggttatagtcacctgtatggcggcgttcctggtgggcaggcggaatatgtccgcgtccctaaagggaatgtggggccgtttaaagtaccgcctttgctttcagatgataaagcgcttttcctttctgatattctgccaacggcatggcaggcagcaaaaaatgcgcagatccaacaaggttcaagcgttgcagtctatggtgctggtcctgtgggattgttgacaatcgcctgtgcacggttgctcggtgcggaacagatttttgttgttgatcatcatccctaccgcttgcatttcgccgccgaccgctacggcgcgatcccgattaattttgatgaagacagcgatccggcacagtcaattattgaacaaacggcaggtcaccggggcgtggatgcagtaatagacgccgtcggttttgaagcgaaaggcagcaccacggaaacggtgctgactaacctgaaactggagggcagcagcggtaaagcgttgcgtcagtgtattgcggcggtcaggcgtggcggcattgttagcgtaccgggcgtctacgctggatttattcacggtttcctgtttggcgacgcctttgataaagggttgtcgtttaaaatgggacagacccacgttcacgcatggctgggagaattattaccgttaattgagaaaggattactgaaaccagaagaaattgttacccactatatgccgtttgaagaggccgcccggggatatgagattttcgaaaaacgtgaagaggagtgccgtaaggtgattctggtacccggtgcacaaagcgcagaggcggcgcagaaggcggtttcaggtctggtgaatgcgatgccggggggaacaatatgatcgtcaggagtggttttcgaggtaaaggacagccatgacgataatcgccgccataatcagaaatcctatcaggatgtaaaatgcttctgccatggttattcccacaaacgaaacggaataattttgcagcaaaagtgaacagtgagaaccaggaaaaattgctgattttgcgtaaagaggatgcgagtgcatcctctgggcaaagcgagttatcgcttgtgcagatgggattaaagcaggtagtcgccagcagcttctggctggtattcgagttccagcacttcaaggtgggttgcaacgccgcccggaagttcccagtgaatggaatcgccaacgcgcagccccagcagtgcggcacctaccggagccataacggaaagctgagtattgctatcggtcatttttgccggatacaccagcgtgcgcacacgcacttcgccatcgctaagattgcggaatttaacccggctgttcattgtcaccacgtcgtgtggcatctcttctggcgaacacatttgggcgcgatccaactctgcgtttaacgcgtcggcgattggcaaaccagcataggcgggttgctccagcagaatatcgatgcgttcggcatccaggtcgttaatgatgatagttggtctggacatttttactccatgtcgtcggtgctgcgagtgtcgcagataaacatacccaaaagaaaaccctcaccgtcaggcggcgagggtttaactcacatgatgatactgactgttgctcactctttgaagtgatttgcgtcacattcagggaattcctcaatgcagcgcattatgtataaatcttaatcgccttggtttatggaagacgaattagcgtgttttgtaaatcagatgattaataacccgctttatcaatcacaaaggttttgccacagttacctgggtgaggttgtggcaagaatgagtttgcagaaagcggagcgttgatggcgtcagctttgatcgagatctgaatttcagtcaaatacgcagggttaccctggcacgttagcttaactgctttcacgttctcttttccccagcttttggcaaaggcggcgtcaaagtcacggcggctcactgttttaccgtaattatccgcaaggaattttccggcttcgctctctttaatttcttgattcaggcgtaccatcgtaccgaagtatgcgtccggatcaaaaccaaagcaggcaccgtgtttggcatattcgtagcgttccaggcaggaacgtccgccagctcctggcatgacttcacttagtttagcggccgtttccagtgataatccggtttccggcgatgaacacattcggctggcgcgcgcttctggtagattcgggattgggcgagtagcgcaaccgaagcgcatccagcggcgttcatcaacaccacgggcagcaaccgatttaggcaatcctggccacagaccatgtacggtcagaaaatcagctttgttggtcgtttcggtttgcaggcgacattcatctcgttcgttacgatttcgatcgtgttgactctggcaaaatccggtttgccaggagagggccaggacatagcgatcaaaatcgccatactgttttgcctgcaacgctaaggcgttggcagaagagaagggaagcagagaaaccgcgagcaacgcggcgttacgccagaatgctttcataatgggtgtggaactcatacatacactgaatactatctattaaatcataaaaaagcccgccaggtgggcttacctggcgggcgtgatgatttattcagcgtttggcgaacgtattagttccacatggcgagaatcggccagccaaccaacagcaacatagagatgtaaatcaccccgaagattgcgccaagacgccagtaatcttttgatttcacatagccacagccgtaaataatcaccccaggaccggttgcatacggcgtcagacagcccatgataccgatagacagcaccagcaggatacacagttgttccattggtacgcccggaatacctttaccgacggccagaataaccggcagcatggttgcggtgtgcgcagacaggctggcaaacaggtagtgtgcaaagtagaacaccagaaccagtacaatcaccgttgcgtttggtgagaatccttccaggtgcgtactcatggtaccggcgaaccagtcaataaaaccagaacgagtcaggccgttagccatcacaaccagagttgccaggttgaccagtgtgttccatgcgctgttatagcgggtaatgtctttccaaggcacaacgtgcagggccagcattagcgaaactgccagcagaccaaccgcagtagcattaatgacttcactgccaaatacccacaaacctaagctgagcaatacaaggccaatcagtgtccactctctgcgtgtcagcgcacccatggttttcagttcatcacccgcccaggttgccacttcttcactgtgtgtgatttccggtttgtacagcacgtaggaaagccacggcgcaatgataagcaagataaccccaaccggcaggaagcagaggaaccactgcaaccagctaatctggataccggcaattttgctgacgaactccagacccagcacgtttggtgccgcaccggtgacaaacatggacgaactcagactggtactaatgaccatcatccacatcaaatagccgccaatacgacgcgcggacggatcgttcgggaatgatttaaacaacggcggcaggtttttaatgaccggaaaaaccgtacccccggtacgcgcggtgttggaaggtgtaaacggtgccagcagaatgtcgataatgacaatcgcataacccaacgtcagcgtgcgtttgcccatgaatttcaccaggaaaagggcaatgcgacgacctaacccggaaacttcataccctaatgcaaaaataaatgcgccaaataccagccataccgtggtgctggaaaaaccagccaggccccatttcagcgcctgtttttgcgcattaaacgctgggtcagctaattctttggcatcaaagagcaggtaattactgccaataacgcaaatagtaaccgcaataaaactgatcgctgttgccggaattggctcgaggatcatgccgacaatcattgccacaaacacagcgaagtaatgccatgcctgcggcggcataccgtcggggacagggataagaaacatgacacccatcaccaccagtggggccaatagtttccatatattatcttttgctaaagacatacgggttctccgaaaattaatatttccaaatttatcaagtgcttaaataattaaatctgtgctaaaaaccaggtaaggatcagtaggtcagcactgccgcctggactgagatttcgttcgatacactccctgtcgaactgccggagataatcgagatcggcgggggttcgaatgccccctttttgcaataatgtttgcgcctcgcgctgtagccagcgcaggcccccctcgccaccgcgcgatgcaacgttggtatcgccgttgatcgccatcagtaggagcaaggtatcgagcaatgccagttcaggatctaacccctgatccagcagagtgaggtaatgcggcaaggcgtgattgatcaccagtggataacccgcttcggcttcaccgcgtgcgccggtaaggccaagctgttggtacaaccgttgacctgccgtcagttgtgaattattggtacgcagttcgcgatcggtcaggccacggcagaaacttgccgccgtagaacaaacggttgttggcgttaccggttggttgagttgaagcaaacggccaattgccgcacatagcagccctaaagaaaaaatgctgcctttatgcgtgtttacgcccgcagtggcgcggaacatatcaccttcgcaagccataccaattgggcgtaatccgtggagtaccgcttctggtgccatttccgcactacaggcaccaaattcaatgaaacggggtagccagccctgaatcgccagcgcgctgcggtggaaatcttccagcgccatatctttgtgcgcaccgcagttaatgcgatccacgaggcctggtttcggtgacagattgacttcagtcagcatggcgcgccagcccagcagggcgtactcatcgattaatgacgtcgcaagctttgtggttttagttgacgttgcaggcatcgacatcgttcagcagtgcctccatgcggttgagtaaatcggtcagttgatgggtttttccacgcgcgcagacggctgcgctttgttcgcacaacaggcagcggcgaggcggcagtgaatagtcgcggcgggagagaatttcgccttcgggcgtcaggacatcgatatcccataaccgcccgagaggatgactatgttcaagctcaatggtggcgagcttgaggtcgcgagccggggcggcaatgctcaacatgccctccggcccgctggcggaaaccagtgcagcctgctcctgaatttgccagccctgttttgcggctaaggcacgcaaggctgtcacgccatgattaaaaattcggcgtgtgacctcgctgtctttaatcggcccaggcgcaaccacggtaaaggagaccagtggaacaggatggcgcttgagccagacgtgttgccgtgcttgcctttcatcccggctgacgagcagctcgggaattgataccgcatggtggctggcgagttcaggaagcaggtgcatggcttattccttcacctgatgcacaacatcgatcaccgagccatcgcggtaacgcacaacggcaacgacgcggtctgtgaattcaatcggctgtggttcaccggtcagcagacgcgcacgttcgcgcagccactcaatggaaaccactttaatgcccgcttcctgcagacgttctgccagttccggacgtgccgggttaactgcgataccgtggtctgtgaccagaatatcgacactggagcctggggtgatgcaggtcagtacgttatccaccagagtcggaatacgaccgcgtaccagcggcgcgacgatgatggaaagcgcagaggcaatcgcggtatcgcagtgaccaccggaagcaccacgcagtacgccgtcagagccggtcagcacgttaacgttgaactgggtgtcaatttccagcgcgctcagtaccaccacgtcgagacgatcaaccgatgcgcctttcgaaccccagttagcgtactggttggcgctgatttcgatgtgattggggttacgggccagcgattgcgcagcatggctgtcaaagctctgcacatccagcagtttgcggatcagacctttttcgtgcaggtcaaccatcgtcgcggtaataccgccaagggcgaagtcggcgcgaatatcgcggctacgcattttgtcttccaggaaacgggttaccgccagcgatgcgccgccggtgccggtttgcatggagaaaccttctttgaagtagccagagttgacaatcacatccgcagcgctacgggcaataagcagttcgcgcgggttagtggtcatacgggtcgcgccagcgccgatttttgcagcatcgccaacgcggtcaactttgacgatcaaatcaacctgatcttgctcaatgcttgccggattatgcggataaggcagcagttcttcggtaagcatcacgacctgttttgcgttgtcggcatcaactattgcatagccgagggagccgcagcaggctttaccggtgtagccgttggcattaccgaattcatcacaggacgggacgccgaggaaagccacgtcgatattcagttcgccgctctgtaccagatgcacacgaccgccgtgagagtggatctgcaccggttctgccagcagaccacgggagatctcttccgccagtggaccacgcaggccggaggtataaatgcgggtaaccacgccctggcgaatgtgttctaccagcggcgcatggcaatcactcagggagctggacgccagggtcaggtttttaaagcccatcttcgcgatgacgtccatcaccatattgacggtcaggtcaccgccacggaaagcgtgatggaaggaaaccgtcatgccgtcctgtaaaccagagcgacgaatcgcttcttccaggttggcgcacagtttgcgatcgcgcgctttttcagcctggtaggtttgctttggcgagttctggaaagcggcaagatcgcattcagcgcgacgattccaggccgctacccgttcttgtcgttgagattgttcaattttctgcgtcattttgattgccttattcttcgcggatgccggaaagttctgcacgggagagcaccagacgggcgcgatcgataaccggaccgtccaccatcttgccgttcagggaaaccacgccgaggccttcgcgagcggcggcttcagcggcttctacgacgcggcgggcgtgatccacttctttctgggtcggtgcgtagaggttgtgcagcagatcaatctgacgcgggttgatcagcgatttgccgtcaaagcccagctgtttgatgtgggcggcttcttgcagaaatccggcttcgttgttagcgtcggaatagacggtatcgaacgcctgaatacccgcagagcgcgcggcctgcaaaatggaacagcgtgcgaacagcagttcagttccttccggggagcgttctgtacgcaggttgcgcacatagtcttctgcaccgagggcgataccgatcaaacgctcggaagcgtgagcgatttccactgcgcgggtaatccccagcggagattcaatcgccgccagcaggccggtgctgccgggttcacgaccacaggctttttcgatacgcaggatctctttttcaatatccagaacatcctgagcggtatcggttttcggcagacgcacaacgtccgcaccaccgcgaacgacggcttccaggtcgttaacaccccattcggaatccagcgcgttgacacgcacaatggtttcaatatcgcgatacagcggatgttgcagcgcgtggtaaaccatgcggcgggcggtgtctttttcacgcaatgctacggagtcttcgaggtcaaacatcagggcatcagccgggtagatgaaggagttgctgaccatcgcggcattggcaccaggcacaaacaacatgctgcggcgggtgcgagttttacgttgttgcagcgaagcggaaatcattggcaatcctcccatggcagagccgggataccgctggcgcgtgccagcagggcttccagtcgtgcacgtaaaatgcagtccagtgcgcctttgtcatcgacattcagctgtacgccgcgcacgttgtagcgggcgagaacgtccagaatggtggtgcgaattgcatcgccaaactgtttctcaacgctgctattgatttgcaggtcgatatcctgcgtatcgagtggggcgatgcgtatcatcacatccccagactcaagggtgcctgcaacggcgggctggtttattttcatttttcacctgtttctcatgcgggggtcttttgacgagctgccgcgtcctggcgggagtgctcaagcaggttctgcaaataatgcagcgtgactgcagggaccagcggcgcgatagccgtgagatcgtttttcgccagcagttgacgtacccgggaagcggatatcggcatctcctggtaacgcagccgctcaatttcaaccagttcgatgggcggtgcggagatagtcggcgtttccagccagtagcgcatatcctggttgtactgggcggtaacgcgacaaaagggttcagtaccgacaaagcggtgagttacacccagcgcgggagcgaggtactgacggaaaatcttcagatcaatttcggtgtaacaatggttaatgacgctctgttctttaatgaagtagcaagggaacgtagcgcgggagatgatgtattcggagccacgatgcacagtcaggcgtggaatatcggcggtgccttttaacaccaaatccagccggtcttcataggggaagcgtgaagaatcttctttgactaaaaacagatgcaaccagtcgcactgtgccgcagcctgttgaatcagataacggtgaccattcgtaaagggattggcgttcatcacaatgcagccaatcttgttccctggatgacgaaattttttcagcgattcggcatagcgtttcagtcgcgtggcgctgttttccatcagcaccatcacgccgggtacgctggtcagcgtggaaaaaccgcactggcggaacagcgcctcgtattcggttttggtataaataaacagatgcgtgctgtgccgctcataggcgaggtttatcaattcagtggctaatgtcagcgccagtccttcaccgcggacggattcactgatagcaacgcatttaataatatttccggcaattccaccgcacgcgataagcttttcatcgcgggttacggtaataaatacttcgactgtggtgtcaacgctcaaatcattttcatgcaggaattgggcgatttccgccatttttttattttctgaacgttttacgcgggtgaaaatatcattgccgaacataataaatagtatcctgaaggtgcatgttgttatcgatttgcaacgaatgttgttcaatgttgcaaactgataaccttttattttcacttgggagaaagggggtgatcgaggtatatctttttctcctttcgctatacatcctaaggagtatttcggcgtgaaattttgatttatttcacatagagttagtggttttttatttatttaatgattttaagttttttaattaatgtaattacgaaatgactcgcaggtttaagtgatttaattgatttaatgaataaaatttgccacgatcataattaatatctatgtattttgattcaacattttaattacatccgtcaaagaggctcgggacaacccgcaaggaaaacaatgttgcagcttaacgagaataaacagtttgcatttttccaaagactggcatttccgctgcgtatctttttgctgattctggtgttctcaatatttgtcattgcagccctggcgcaatattttacggccagttttgaggactatttaacgcttcatgtacgcgacatggcaatgaatcaggcgaaaattattgcctccaatgacagtgtcatctctgcggtgaaaacgcgtgactacaaacggctggcgaccatcgctaacaaattacaaagagataccgattttgattatgtggtgattggggaccggcactcgatccgcctttaccatcctaatccggagaaaattggttatcctatgcagttcaccaaacagggcgcgctggagaaaggggagagctacttcattaccgggaaagggtcaatggggatggcgatgcgcgccaaaacgccaatctttgatgacgatggaaaagtcatcggcgtggtgtcgattggctacctggtgagtaaaatcgatagctggcgggctgagtttttattaccgatggcaggtgtgtttgtcgtgctgttagggattctgatgttgctgtcgtggttcctggccgcgcatatccgtcggcagatgatgggcatggagccaaagcaaatcgcacgcgtggtccgtcagcaagaggcgctgtttagttcggtttatgaagggctgattgcggtggatccgcatggttacattaccgccatcaatcgtaacgcaagaaagatgctggggctgagttcccccggacggcaatggttgggtaaacccattgttgaagtggtcaggcccgccgatttctttaccgaacagattgatgaaaaacgtcaggatgtggtggcgaactttaacggtctgagcgttattgccaaccgggaagctattcgttcaggtgatgatttgctgggggccattatcagctttcgtagtaaagacgaaatttccaccctcaatgcgcaactgacgcaaataaaacaatacgttgagagccttcgtacattgcgacacgagcatctcaattggatgtcgacgctcaatggtctgttgcagatgaaagagtatgatcgcgtgctggcgatggtgcagggggagtctcaggcccagcaacagcttattgacagcctgcgcgaggcgtttgccgatcgccaggtggcggggctgctttttggtaaagtgcagcgcgcccgggaactggggctaaaaatgatcattgtccccggtagccagctttcgcaactgccgccaggactggatagcaccgagtttgcagccattgtgggcaatttacttgataacgccttcgaagccagcctgcgtagcgatgaaggaaacaagatcgttgaattattcctcagcgatgaaggcgatgatgtggtgattgaagtcgccgatcagggctgcggcgttccagagtctctacgagacaaaatatttgagcagggggtcagtacgcgtgctgacgagcccggtgaacatggcattgggttgtacttgattgccagctacgtaacgcgctgcggtggtgttatcactctcgaagataatgatccctgcggtaccttattttcaatctatattccgaaagtgaaacctaatgacagctccattaaccctattgatcgttgaggacgaaacgccgctggcagagatgcatgcggaatatattcgtcacattcccggattcagtcagatattactggcgggaaatctggcgcaggcccgaatgatgatcgagcgttttaagccggggctaatcttgctcgataactatcttcctgacggtagagggattaatttactgcatgaactggtgcaggcgcattatcccggcgacgtggtgtttaccactgcagccagcgatatggaaacggtgtctgaagccgtacgttgtggtgtatttgattatctcattaagcccattgcctatgaacggctggggcaaacgctaacccgtttccgccagcgtaaacatatgctggaaagtattgatagcgccagccagaagcaaattgatgagatgtttaatgcttatgctcgcggtgaacctaaggacgagctaccgaccggcattgaccccttgacgctaaacgcggtgcgaaaactgtttaaagagcctggtgtgcaacatacggcagaaacggtggcgcaggcactgaccatcagccgcaccactgccaggcgttatcttgaatattgcgccagccgccatctgattattgctgaaattgttcacggcaaagttggcagaccacaacgcatataccacagtgggtgacatgataaagccggaggaaacttgcctccggcattactatttacttgcctgtgaccgctgctgccgttcctggcaccatcagctctgtagcaacgataacaatcaccaaaccaacaagcaccggtaccgaggtgcgttttacgacttcaaacggcgagatcttcgccatcccggcaaccgcaacgactacgccagaaacgggcgaaagggtacggccaaggtttgacgcctgcagcatcgggatagtcaaatacgccgggttaatgccggaagagtgcgccagtttcgggatcatctcaacaaacgcataaaacggcgcattgcctgaaccggtcgtgactgccgccagcattgtcagaatcaccaataccagcatcaggatgatactcgccgaaccaaacgaggtagcgatagaaatcagactttgaataaagccgatggtgctaagcccctgagcgaataccccagcggcaaccagcagcatcaccacgttagcaaacgcatctgccatcccgcgataagccacttccagaccagagaaaactttctgggtattaaagctgcggaggaactccagaatggaggcaatcagcatacaaatcaccagaatagtgatgatgtgtaattgcggaccccatttaccgtcaaaaatcagtacaccgatgatcggcgtgaacggcaaaatggcataaaacgcaggagcagtggtggtgatttcactgacatctaacatttcatgagagatgtgctcttttttatccagataacgttgccagaagaagtgggcgatcgccatgccgataattgcagcaattgagataggcagcgtcgttttgaaggcgaagtcaatcagcgacatttcggaagcttgcgccgccagcaccacatcccctgaagtcggtgcgagaataatcgccgccggggaggcacaaatggcagcagctgcgccacgactgataccaacgtttaccatcaccggaaatagggttgccatcagcaaaacacccagaccggttgcggaagagacggccagagacatcagacaggcgacaaaataggcggcaatcatcagcaggtaaggggagttaatatactgcaatggttttgacgccagcttgaccaccatatcattcgcgccgatatgggtcatgtaagcggcaaatccacacagcatcataatcatcatgccgaggtcgccgccgcggctcattagtaatattttaacgtattcaacgatatccgtggcgctgtagcctgttgaagcctggctggacggtaacactttgtgccccataatggcactgataatcagcaataacaggccaccgacaaataacacaccagtggcggaataccctttaatgatgtagcgagctacacccacaataaccacaaccccaataaggagctcaatgaatgtcagcataatttttcctgtctccaggccccaaagtaaataataaaaaattcctaaagcttaaggaaaaaatatgcccaataaattggcgatgaatgctgattaaaatcaagaaaaactgccattaagacattgaagttgctgtttttatacatagataacaaaacgcatatttagcggttggcaattatcacataataatgtgtgcaaattgatggtggattgatgcaaatttgttaattgcaatggtgttagctgcggctgtgcgctcaaaaaataatctaatatgagcataggttgacgatatatattatatacttcgttaagatgattgttgtatctcgttaaaaaataaaataatttttccttgattgcattttgtcatcaaaaaagacttggtttttcttttttgactattcccatcgcagaaaacgacgcatcatctttaatcgatgcgcggaaatatttaacttgaacaagcggaaataaatagagcagctattcagattattctttatgttgggtctattaaggttatgttaattgtagctttgctatgctagtagtagatttttgataaatgttttatggtcacaaatgaacgtgagtaaatatgtcgctatcttttcctttgtttttattcagttaatcagcgttggtaaagtttttgctaacgcagatgagtggatgacaacgtttagagaaaatattgcacaaacctggcaacagcctgaacattatgatttatatattcctgccatcacctggcatgcacgtttcgcttacgacaaagaaaaaaccgatcgctataacgagcgaccgtggggtggcggttttggcctgtcgcgttgggatgaaaaaggaaactggcatggcctgtatgccatggcatttaaggactcgtggaacaaatgggaaccgattgccggatacggatgggaaagtacctggcgaccgctggcggatgaaaattttcatttaggtctgggattcaccgctggcgtaacggcacgcgataactggaattacatccctctcccggttctactgccattggcctccgtgggttatggcccagtgacttttcagatgacctacattccgggtacctacaacaatggcaatgtgtactttgcctggatgcgctttcagttttgagacaaatgaagttttagtaacttctttaaaatcaatagctaaaataagtaacatcaaaaataacgcgacttttatcactttttagtaaagttacactggacaaagcgtaccacaattggtgtactggtaaccgacacagcatttgtgtctatttttcatgtaaaggtaattttgatgtctaagattaaaggtaacgttaagtggtttaatgagtccaaaggattcggtttcattactccggaagacggcagcaaagacgtgttcgtacacttctctgcaatccagactaatggttttaaaactcttgctgaaggtcagcgcgtagagttcgaaatcactaacggtgccaaaggcccttctgctgcaaacgtaatcgctctgtaagatacgtcagcaagaattcaaaacccgcttaatcagcgggttttttttggtctttagtgtgcggttgaggccgaaaacagccagaatgccagtgcggtcatggcaaaagaccccagaaggttgacgaaaacgttcagtaatgcccagccaaagcggccctcttgtaacaaaaacaccacttctgccgaaaatgttgagaaggttgttagaccgccacaaaatccggtggtgattaatactttccacactggatcaatgttcgtcatcctgctgaaccatgcgaatcctattcctatgatgaatgccccaatcaggtttgctgtcagcgtccccaacggaatcgcctgatgcagtgggttaaatcgcatacttaacagccatctcgccacgcttcccgtaccaccgccaataaaaactgctaaaagaagttgtaacactgcaaaatcctgctatttgatttgtatgagtgataagtgtaacgccgaataatcgtcgttggcgaattttacgactctgacaggaggtggcaatgctggttgccgcaggacagtttgctgttacatctgtgtgggaaaagaacgctgagatttgtgcctcgttgatggcgcaggcggcggaaaacgacgcatcgctgtttgccctgccggaagcattgctggcgcgcgatgatcatgatgcagatctatcggttaaatcagcacagctgctggaaggcgaattcctcggactttacggcgagaaagtaaacgtaacatgatgacgacaattctgacgattcatgttccttcaacgccggggcgcgcatggaatatgctggtggcacttcaggcaggaaacatcgtcgcccgttatgccaaactgcatctctatgatgcatttgccattcaggaatcacgccgtgttgatgctggtaatgaaatcgctccgttactggaggtggaagggatgaaggtcggtctgatgacctgttatgacttacgctttccagagctggcgctggcacaggcattacagggagctgaaatcctggtacttcctgccgcctgggttcgcgggccgctcaaagagcatcactggtcaacgttgcttgccgctcgtgcgctggataccacctgttatatggtggcggcgggggagtgcgggaacaaaaatatcggtcaaagccggattatagatccctttggcgtcaccattgcggcagcgtcagaaatgcctgcactcattatggcggaagtgacgcccgaacgtgtgcgtcaggtgcgcgcgcaactgcccgtcttaaacaaccgtcgctttgcgccgccgcaattattatgatgtttttttactcggcgcttgattcaccttgttacagattgctattgtgtgcgcgcgtcgaatgaccgttaatattctctggtttttaaggcgcgttctgttgccggttatatgtcaagaaggtatctatgggtgagattagtattaccaaactgctggtagttgcggcgctggtcgttctgctgtttgggactaagaagttacgtacgctgggcggagaccttggagcggccattaaagggttcaagaaggcgatgaatgatgacgatgctgcggcgaaaaaaggcgcagacgttgatcttcaggctgaaaagctctctcataaagagtgacgtggcgagcaggacgctccctcaatatcttgttcgatacaaaaaacccgcttcaaaaagcgggttttttatcagacagatgtaagtaattattacaggattacttaacttccatccctttcgcctgcaaatcggcgtggtaagaagagcggacaaacggaccgcatgcagcatgggtaaagcccatcgccagcgcttcggctttcatttcgtcgaactcatccgggctaacgtaacgttgaaccggcaggtgatggcggcttggctgcaaatattgccccagcgttaacatcgtcacaccatgacggcgcaggtcgcgcattacctcaataatttcttcattggtttcacccagtcccaccatcagaccagacttggtcgggatttccggatgcgcttctttaaagcgttccagcagcttcagcgaccagttgtaatctgcaccaggccgtacctgacggtaaatacgcggtacgttttccaggttatggttgaacacatctggtggcgttgcagtcagaatatccagagcacgatccatacgaccgcggaaatccggcaccagagtttcaattttgatttgcgggcttttttcccgaatggcagtaatgcaatccgcaaagtgctgggcaccgccatcgcgcaggtcatcacggtcaacggaggtgataaccacataacgcagcgccatatcggcaatggtctgcgccagtttcactggttcattggcatcaggagctaccgggcgaccgtgggcaacatcacagaacggacaacggcgggtacaaatagcgccgaggatcataaacgttgctgtgccgtggttgaagcattccgccaggttagggcaggaggcttcctcgcagacagaatgcaggccatttttgcgcattgcggctttgatgccctggatacgtgtagagtccgctggaagcttgattttcatccattccggcttgcgcagcagggcttcgcgctctgttgccacgtttttaaccgggataagggccatcttatcggcatcgcggtatttaacaccgcgttccatcacaatgggtttactcatagcgtgcgtgttccagttgcgaattacgaaggaaagcgtttcaattcaatagattgttgtaattatcaactatttttgaattaacgactggcagtatatcattgaaacggacctgaaagcagccaaagcggtcgcgaaaatgtaaaattgttgttggattgtgccattttatcgttctgcgctgtgatctggctgtaacaatactttttcaaaatgcattacggataacatctattactccgtgcaggatgggatcacgcaggctgaatttgttgtagtggatagagaaatctatttgctcctcatttaaggacggaaaaggcagtttttccagcggccagcagcggctaaacaggttataaaaacggctgggaataatcgctaacatgtcactgttggcaaccagtgcagcgattgtcaaaatgttgtagctggtgaaattgatttgccggtccggaaacatttcttgaactctctgccgcagaccgctgaaattttgctcttccggtaacagaagtacatgcgcagcgttgtcgatagtctctctgtcatcttctaaagagagtagtggatttccctcgcggcaaattaacaccatattgtcggtgaacagaacatgatgttgcaccgtacgattggtgcaaaacatgttatcgatgatgagatcggtttgaaactgactgagttggttttccgcgtcgctgatgggcgggttgcgcagtaaaagctgcggatagtgagttttaatcgcccgatagatgacaggaaggaccagtgctccgaccgagggagtggtcgcaatagttatcgttcgttgcttatcatagcttccttcgatatccagcgcgccaagaatggactcaaggccctgactgatatactcatgtagatgcatcgcaaatgcggtaggagtgacaccctggcctttgcgaataaacaatgggtcagggaatataacgcgcagtttctgaatagactgactgattgccgagggggtcagattaagcactttcgctgcattaacgatccctttatgtacatatacagcttcaaaaatagtcagaaggttaagatcaatatttcgtaaggttgtaaatatttgtggtttaccttctgacgactttctgcttaaacagggttcaatttgattattactatccacgcacttactccaattttattcatggaaaaataatatttaaaaaattacaataatcttatgtctaattggaacggaacgcttttgctcaccataatcaactatttcaataggttaatcaatggggtgagttacggagcaaggcgtggcaccgcatttctgcaagtgataaagaaaatatacaaacgcgaaggagatgtaaagcattagcagatattatgagtaatgacccagtgtaaattgggccattgatgtatggaattaagcggtaatatattcgaagtccggattgtttagtagcgctaaaatattttccagtaaacgtggagcaatattattagtcgtcgcttcgggtttccattgtgatattttagccatttccattccggcatacccacaaggattaatacgtaaaaatggtgaaagatccatattgacgtttaatgccagaccgtggaatgaacaaccgcgtcgaatacgtaaacccagtgagcaaattttcttttccccaacatagacacctggcgcgtcagcccgaggatgcgcttctatacccagttcagccagggtattcaccactgtttgctcaagcaaggtcaccagttcacgcacaccgagtttacggcgtttcaggttaagcaacacatacatcacctgttgccccggcccgtgataagtcacctgcccaccgcgatcgctctggatcaccggaatatcacccggcattaaaatgtgctccgcttttcctgcctgaccttgggtgaataccggatagtgctcgaccagccagatttcatcaagggtactatcatcgcgggtatcggtgaattcatgcatagcctgggagattggctcgtaaggctgaagaccgagctggcggacaagaattttatcctgatacaaaacggcatctccgtggagaatgagtaaaagtgggggaaaagtatatcacagcgaggagaggggagttacccgaccaggagccgggtaacggagaagcgagttacagaaccatgcggacaatatcgattttgcccagttcttcatacagtgtttcaacctgctcgatatgagtggcgttgatagtgatagataccgagtggtagttgcctttgctgcttggttttaccgttggggtgtagtcacctggcgcatggcgctgtaccacttcaaccacctgatcaaccagctcaggtaacgcctgccccataactttgtaagtaaaaggagtagggaattcaagcagttcgttaagtttggttttcatgtcagctccggcgtaacgtaattaaatagcaactcccgccagaaggcgggagttttttactgatgcttagtatatggggacggaaattacactttcaagtgtttaatttttaaccaaaccagtgatggaacattaatttaatgtaatcaatgattttgccgaagaagttaccttccgggatttcttgcaacacaaccagcgggcgttgctcgatcgttttgccatcaagctggaagttgatagttccgacgacctgattcttttgcagcggcgcatgcaattcactgctgttcagcacatagctggctttcagatctttcatgcgaccacgcggaatggtcaggtacacgtctttatcaacccctaacgaagcgcgatcagaatcaccaaaccaaaccggttcagaggcgaactctttacctactttcagtgggttaacggtttcaaagaaacggaagccccaggttagcagttttttactttcggcttcacggcctttaaaagtacgtccgcccattaccgcagaaatcaagcgcatctggccttcagtcgcagaagcaacaaggttgtaacctgctttgtcagtgtgtccggttttgatgccgtcgacattcaggctgttatcccataacaggccgttacggttcagctggcgaataccgttaaacgtaaattctttttctttatagatcgagtattcattcggtacgtcacggatcaatgcctggccgatcagcgccatatctcgcgcggagctgtactgaccatcagcatccagaccatgtaccgtctggaagtgggtatttttcaggcccagtgcgttaacgtagctgttcatcaagccaacaaaagcgtcctggctaccagcggcaaaatcggccatggcgacacaagcatcgttacccgattgcaggttaataccgcggatcagctgagaaaccggaacctgcatgcccggtttgaggaacatcagcgaagaacctttaaacaccgggttaccggtggcccatgcgtcgttgccgatagtgactaaatcagtttctttaaatttaccggctttcattgcctggccgataacgtaactggtcatcattttggtcaggctggcaggatcgcggcggacatctgcgttctgttcggcgagcactttgccggagttatagtcaatcaggatgtaggactccgcatcgatctgcggtacacccgggatcatagttttgatattcaggtcatcggcatgtgcagcagagataaaggctgtgcaaagagccgtggtgagcgccaggcgcttcatgatacgagcggaaaaaatggtattcatggtctgaactacgacatccgtgatggaattaaaaaagtgccctactatagcaaatgcactaccggcaggcatctgactttccgcgtgactttgttaacgtcatttacagaaattgacacatcagatgcctgctttacgctactgcgcggtagtaataaatgactgtaattgggcttcggtttgcaaacgttgctgcaaggtactggcttcggctttgctggcgaatgggccaagctggatccgccagaccgcgccattttgagttacgcgaccggggacgccgaacttctgtcccagttgctgttggtactgttgcgcacgagcctgatcgcttacggccccgacttgcaccataaagttgccgctggcgctttgcgagacggcttgcggtgtcaccattgcaggcgaggttgcaggcgttgtcgacggagctgtaacaacgggctgtggcgcaggcgtcggttcgctgccttccagtacaccaggcgctaaggtcgttggtgcgccgaggaaaccgctactggttaccggcgcgccggtcggatcttcgctttttagcgtcgaattactgaccggaagaatgtcaccctgcgggccagacactgaacttgttcccgcgccaccgcttaaatcgggaggtgcaggcagggcgtaagtctgtttggcgactgtggtacaagccataccaggaccagaaagcgaaccatcctgggcaacaataatcggatcgatacgaactttggtgttgtttgacgtgttaagacggtcagctgccgcgcgagaaagtgaaataacgcggtcgttgccgtaagggccgcgatcattaatgcgcaccacgatcattcgcccgttagccaggttagtgattctggcgtagctggggatcggaagcgttggatgggctgccgtcagctgtgtcggatcgaatgcttcgccagaggccgtcaggttactgccgggttcggcatcatagattgccgccagtcccgcctggctaaatcgagacggatcctgcacgattttgtagcttttaccgtcgcgctggtaatcctgatttgccgtcgcgttcagtggttcgaaacgcgggtccgccccgctaatttcaactatagggccgttacataccgcaggctgcggtacacttaccgtctgttgctgaccatcatcgcttgtacatgccgcgagcattcctgccgcgatgcagatcccgagccactgcttacgcattgcgcacctcttacacgcttttcgacaacattttcctgtgggtgtggattgacattacaatcccgaacccagccatcagcacaattagcgccgatcctccataactgaccagtgggagcggaacccctacaaccggcagaataccgcttaccataccaatatttacgaagacataaacgaataatatcagcattaagccgccagccatgacgcgaccaaaggtggtttgcgctctggcggctatccacagcccgcgcatgatcagcagaatgtagagagcgagcagaatcagaatgcccactaatcccagctcttccgccagtaccgcgaagataaagtcagtatggcgttcggggagaaattcaagctgtgactgagtgccgtgcagccagcctttgccgcgtaatccgccggagccaatagcaattttagactgaataatgtgatagcccgcgccgagtgggtctgattccgggtccaggagcatcattacgcgctggcgctggtaatcatgcatcaggaagaaccacagaatcggaatgaacgccgctaccagcactactgcgacgccaatcagacgccagctaaggccagagaggaacagtacaaacagaccggaaagcgcaacgaggattgatgttcccaggtcaggctgtgcagccaccagcagcgtgggcataaatatcagcaccagcgcgatgccagtgttcttcaacgatggcgggcaaacgtcgcggttgataaagcgcgcaaccatcagtggtacggctattttggcaatttccgacggctgaaaacgaacaataccgaggtccagccagcgttgagcacctttagagatggcaccgaaagcatctaccgccaccagcaaaataatacagatgatatagagatagggggcccagccttcataaacgcgtggaggaatttgcgccatcaccaccatgatgaccagacccatcgcgatttggccgattttacgctccatcatgccaatatcctgaccgctggcgctccagataaccagggcgctgtaaaccagcaatgccagtaagatcagcagcattgtgggatcgagatggactttatcccagaatgtttttttattcggattatccgtcatgattaatggtcctccgctgcggcaaccgctggattttccgcaggcagatcggtgttgttatcacccagcataatgtggtcgaggatctggcgcatcagtgtaccaaccgccggacccgcaccaccgttctccagaatcatggcgacagccacttgcggattgttgtatggcgcaaaggcggtcatcagtttgtggtcacgtaaacgctcggcaattttgtgcgcattataggtttcgttcgctttcagaccgaagacctgagcggtaccggatttcgccgcaattttgtacggtgcgctagcaaagtatttatgcgccgtaccgttagggcggttagcaacaccgtacataccgtctttcgccagctcccagtaaccggaatgaatatcgccgacgggcggttcatgcggctgtacccatggcacctgtttgccgtcttcggcggtgctcatcagcaaatgaggaaccttcacgataccgtcattaatcaggatcatcagtgccttactcatctggattggggtcgctgtccagtaaccctgaccgataccaaccggaatggtgtcaccctgataccacggttttttaaagcgtttctgtttccattcgcgggtaggcatgttgccggaacgttcttccgccaggtcgataccggtgtaatgaccataaccgaatttacccatccattcggagaggcgatcgatccccatatcgtaggccacctgatagaagaaggtatccgcagattcttccagcgatcttgtgacattcagacgcccgtggccccattttttccagtcacgataacgtttttccgaacctggcagttgccaccagcctgggtcaaacagcgtcgtattgcgcgtgatcaccccggcgctcaatgccgaaaccgccacatagggtttaactgtagacgcgggaggataaaccccctgtgtggcgcggttcaccagcggtgtattcggatcgttcaacaaggcggaataatctttgctggagataccgtcaacaaacaagtttgggtcataactaggcgtggaaaccagcgccagcaccccacctgtacgcggatcggtgactaccacagctgcgcggctacccgccagcagcgtttcaatatattgctggagtttgagatccagcgtcaggtaaatatcgtgtccggcttgcggtggtacttcttttaactggcgaataacacgcccacggttgttaacttcaacctcttcataaccggtctgaccgtgcagcacatcttcatagtaacgctcaatgcccagcttaccgatatcatgcgttgccgcatagttggccagtttgccgtcattattcaggcgttcgacgtctttatcgttgattttcgacacatagccgatgacgtgggtcaacgccgaaccgtaaggatagtaacgacgtttatagcctttaacttcgacacccggaaaacggtactgattgacggcaaagcgagctacttgtacttcggtcaggttagttttcaccggaatagaggtgaaacggtgtgaacgtgcgcgctcttttcggaatgcagcaatatcgtcatcggtcagatctaccacgctgcgcaaagcgtccagcgtttgctgcacgttatcgactttctccggcatcatttctatctggtagatagtgcggttgagggccagagggataccgttacgatcgtagataatgccgcggctgggcgcgataggcaccagcttaatgcggttttcattagagcgggtctggtagtcggtaaagcgaacaatttgcagattatacaggttggcgataagcacgccggtcagcagcaaaatccccaaaaaggcgaccagcgcccggcgcacaaacagcgcggactctgccgtatagtcgcgaaaagagttctgtagtttcatccgctgcgttttctactcaaagctcccttatcactcacggtgataaggatggttggtggtgatgctccacgcccggtacagactctctgcgaccagcacgcgaaccagcggatgggggagggtaagcgccgacagcgaccagctctgctcagccgccgctttacaggcaggcgacaacccttcaggcccgccaatcagtagactgacgtcgcgaccatccagcttccagcgttccagctcagcggctaactgcggcgtatcccagggcttgcctggaatatcgagggtgacaatgcggtttttgcctgcggccgccaacatctgctcaccctctttgtcgagtatgcgcttgatgtccgcattcttgccgcgttttccggccggaatttcaatcagctcgaagggcatatctttcggaaaacgacgcaggtactcggtaaaaccggtttgtacccagtccggcattttcgttcccacggcgacaagttgcagcttcacgcattaactccagagtttttccagttcatacaggcgacggctctcttcctgcatgacatggacaatcacatcgcccaaatccacgacaatccagtcggcgctgttttcaccttctacgccgagcggtaacaggcccgctgcgcgagactcctgcacaacgtggtcagcaatggacataacatgacggctggacgtacccgtacagatgatcatgcagtcggtgatgctggatttgccctgaacgtctaaggcgatgatgtcctgacctttgaggtcatcaattttgtcgataacaaaatcctggagtgctttaccctgcaagttttccccctgggtgaatcaaatagataaaaatggtctgtcagtatacctgaaccagaggcgatttcgggacaattgtcgccgaatcggctttcgaaagtgggctatcatcccaccccgcgccgcagattgcatcgccatttttgtaaaacaatttctacaaagtcgtgtctggcggaaaaagtctggctgcggagaatatcagcctgcccgggtctgtcaatggtcgttgcggcttacccgtaaaaaaacagaaaagtcatgcattctcgaccccgatggcacggctattgaggacgcgtagcgtcgcgaatttttggttgatatcaatggcgctccaacacccctggtcaacgcgaaaatgccacatagcttcggcaggcatgccaattaaacgggcgattaacagactcagtacaccctgatggctgacgactaaaatattctgatagtgctgaaattcactaagccttgcgataaagcgttccacacgttgcgaaaatgcctgaaatccttcaccgttcgtggggattgcatgctgccagtcattgcaccacgcgctatagttttcggcatcttcttgcatgaggtcgcgatgatgtcgcatctcccagtcgccaaaaaacatttcgttgagttcaggtatgatttgcacggggagctggcggtcactgagaaccagtcgcgcggtatgctgtgcccgttccagttcactgcataaaaccagatcaaaggaaacaccatgtagcagcgtatgcagattttgcgcttgctcaataccgcgcgcggtcaggggggtgggcgcatgaccgctgtaaagaccatcgatattcgcttgcgtttcaccatgacgaattaaccacagtcgcatcatgccctccgtaacgacaggtatcagcgatacaagccttgttggttaatgtaagtcagtaccggttccggcaataaatcctcacatgattcaccgttttgcaaacgttcgcggatgatggtcgccgagatgttaaaccacggcgtttcagccagataaattttaccggcaggctgaaggtgaagatcttccgggttatgtgtcaaatgatcttccagccattgctggtattgcggttgcgccatttcaagtgggtaacctggacgccgacagacgatcaaatgtgcattgtcgagtatcgtttcgtattcgtaccaggtcggaaaggtcagcagtgaatcctgaccaataataaacgccagcggcacgtccggtccttgttcctgccgccactctttcagtgtttgcgcagtgtaagagggggcattgcgctttagctcgcgttcatcaagagtaaataatggcttgtcggcaatcgccagttcaagcatgtgtttacgctgcacgctgttcgcttccggctggggacgatgcggaggaacattattagggatgattgtgacccgcgtcagaccaatcaaattcgccagcgtttccacgggttttagatgaccatagtgcaccggatcaaaggtgccgccaaacagagcctgtaaagatttcatatcaaccgtcgataaatacgtccgccaggggtttatggcacaacagaagagataacccttccagctctgcccacactgactgaccgtaatcttgtttgagggtgagttccgttcgtgtcaggagttgcacggcctgacgtaactgcgtctgacttaagcgatttaacgcctcgcccatcatgccccggcggttctgccatacccgatgcttatcaaacaacgcacgcagtggcgtatgggcagactggcgtttcaggttaaccagtaacaacagttcacgttgtaatgtgcgcaacaaaataaccggttcgctgccttccagacgcagttgctgaagaatatgcaatgcgcgcttactttttcccatcaacaaagcatcaacccaatgaaaaggggtgaaatgcgcggcatcattcaccgcctgttcaacgcgcggtaatgtcaatttgccgtctggccagagcagcgataaacgctccagtgcctgagccagcgccagcaggttaccttcataacagtagcagagcacctgatttgccgcgtcatccagttctaagttgagctgttttgcgcgcgcagcaacccagcggggaagctgagcctgctccggtgtctgacaggtcacctgcacgctgcgattcgcaagcgcagtaaaccaggcggcattttcttgcgctttgcttaatttattaccgcggacgatcaacagcaggtcgtcatgcagaagtccggtgagtgtgagaagttgctcattgatcgccgcattcggtccgttttctggtaacaacagcaatagcgtttgtcgactggcaaacagactcatagcctggcataacgaaaagatcgcattccagtcagtgttgggatcaatggaaaaagtgtggtgttcttcgaatccttgtgccgcagctacctgacgaacagcgtcctggctttcctgcaataacagaggatcgttaccaagtaaaagatacgccgcgcgcagcccttcattgagctgcgcgcggagttgttccgggtacaaccgaatcatcagttacccagcgtggtggagacgcgtgcaggcgttgccggagtatccgttgtggtcgacgtctgttcttcgtcggaacgaatatccgcagcacggatgcttggcagcttacgaatcagctgttcggcagcacggtcgtacatctcttttacgatcatgtcttgttcgttatctttcgctaacgccatttgcgggttatcgaagaacgaacggaagactttggcgctaatcgggtagatatcacggccggggatcaacacggtcgcattaaccgtcatgatcatctgatactctgctgtttgaccgttacggaataccgatgcggtatctttcgcgatgctcactttacccaaacgcaaggatggaacgtccttacgcgtggtttctttatcaagcaactcgacaccattcagacgtaactggttacgcaccgcacggcttaatggcccgttcggatcgcctgagtccaggatcatgaccttcatagtggaaggaacctgcgtggtatcacgcagatgccagccacacccggcggtgattaacaccgccagagataacaacaatgttgccagatatcgcacgcttcctcccgcgcttagccaacgaccagattgaggagtttacctggtacgtaaatcactttacgtacagtaacgccatcaagatattttgctaccagatgttcctggccagcacgttcgcgaacctgttcttccgttgcgtccaccggaacggtgattttggcacggactttaccgttaacctgcaccacgaccagcgtggagtcttccaccatcgctttttcgtcagcaaccggccacggcgcgttgtcgatatcgccttcgcctttcagttcctgccacagcgtgaagcagatgtgcggggtgaacgggttaagcatacggacaacggccagcagtgcttcctgcatcagagcgcgatcctgctcgccatcggttggtgctttcgccagtttgttcatcagctccataatcgccgcaattgcggtgttgaaggtctgacgacggccgatatcatcggtcactttagcgatcgttttatgcacatcgcgacgcagcgctttctgattttcagtcagcgcatcaacgttcagtgccgcaacatcaccttttgctgtgtgctcgtaaaccagtttccagacacgtttcaggaagcggttagccccttccacaccggattcctgccattcgagagtcatatcagccggagaagcaaacatcataaacagacgaacggtgtccgcgccgtaacgttcaaccatcacctgcgggtcgataccgttgttcttcgacttggacattttgctcatgccggtataaaccagttcatggcctgccgcatctttcgctttcacgatacggcctttctcgtcacgttcaacgatagcatcaaccggggaaacccagttacgttcgccgttttcgccaacatagtagaaggcatctgccagcaccataccctgacacagcaactgtttcgctggttcgtcagagttcaccatgcctgcatcacgcatcagtttgtggaagaagcggaagtagagcaggtgcataatggcgtgttcaataccaccaatgtagatatccaccggcagccagtagttagccgcttcggaatccagcataccttctttgtactgcgggcaagtgtagcgcgcatagtaccaggaggactccataaaggtgtcgaaagtgtcggtttcacgcagtgctggcataccgttaacggtagttttcgcccactccggatctgctttaatcgggctggtaatgccgtccattaccacatcttccggcaggatcaccggcagctggtcgtccggggtcggcattacggtaccgtcttccagcgtcaccatcggaatcggcgcgccccagtaacgctgacgggaaacaccccagtcgcgcaggcggtagttcactttacgctcgccaacgcccatcgcagtcagtttatcggcgatggcgttgaaggccgcttcatggtcaagaccgttgaactcgccagagttgaacagcacgcctttttcagtcagggcttgctgagaaagatctggctcagagccgtcagctgccaggataaccggtttgatgttcaggccgtatttagaggcaaactcgtagtcgcgctggtcgtgccccggtaccgccataactgcgcccgtgccgtactccatcaatacgaagtttgctgcccaaacgggaatttcttcgcccgttaatgggtgaaccgctttaaagccagtatcgacgccttttttctccatcgtcgccatttcagcttcggcaactttggtgttacggcattcgtcaataaaggccgccagttcaggattattttccgccgctttctgcgccagcggatgacccgcagctaccgccaggtaggtacaacccataaaggtgtccgggcgggtagtgtaaacggtcagcgtgttgtcatagtcgttaacgttgaaggtgatctccacgccttcggaacgaccgatccagttacgctgcatggttttaacggtgtctggccagtgatccagtttatccagatcgttgagcagctcgtcagcgtaagcagtgattttgataaaccactgcgggatctctttacgttcaactttggtatcgcagcgccagcagcagccgtcgataacttgttcgttcgccagtacggtctggtcgttcgggcaccagttgaccgcagaagtcttcttatataccaggccttttttatacagctcggtgaagaatttctgttcccaacggtagtattccggcgtacaggttgccagctcgcggctccagtcataaccaaagcccagcattttgagctggtttttcatatacgcgatgttgtcgtacgtccacggtgccggagcggtgttgtttttcaccgccgcgccttccgcaggcagaccaaacgcgtcccagccgatcggctgcaggacgtttttgcccagcatacgctggtagcgggcgatcacgtcaccgatggtgtagttacgtacgtggcccatgtgtagtcgaccagaaggatagggaagcatagacaggcagtaatacttctctttgctctcgtcttcggttacttcaaatgtgcgcttctcatcccaatgaagctgtactttggattctatctcttccgggcggtattgctcttgcatggcagccagtggtcctgttttcaatacggctacaaatgtagcgttgaggtggtttttcagatccgcatagcatagcccaaacgtccgcgtcaaaacagcctttcgcgcactcgacgttgaaatgatgcccggattattcatacattaatttacagagtttgtgggcgtattagcaaagcaaggaacaaagaacgtctattattatagtcagttaacgacccgggagatgaaacgatgaacaaggttgctcaatattaccgtgaactggttgcgtcactgagcgaacgcctgcgcaatggcgaacgtgatatcgacgcactggtggaacaggcgcgcgagcgcgtaataaaaacaggggagttaacgcgaaccgaggtcgatgagctgacgcgagctgtcagacgtgacctggaagagttcgccatgagctatgaagagagcctgaaagaagaatctgacagcgtctttatgcgggtgattaaagaaagcttgtggcaggagctggcagacatcaccgataaaacgcagcttgaatggcgcgaagttttccaggacctcaatcatcatggggtttatcacagcggagaagtggtcgggctgggaaatctggtctgcgagaaatgtcacttccatctcccgatctacacaccggaagtgctgacgctatgcccgaaatgtggtcatgaccagttccagagacgcccgtttgagccgtaatagtctgatttcgcacagcaataaagagaatatgggccgaatgaaattccccggcccttgtttttatctctacagtaaatcttcagtctcacgaatttcctgactgacatctctggttccggatgactgaactttacgatacaggtcgagagcctgtcggagatcgacaggtcttccttctccgtagtgatacataatggccaggttataccaggcagtggcgtcattgcattcagcggctttcgtaaaccattcaaaggcagcctgataatctttctcaacgccttgtccgtgtttatacatataaccgatgttgacgtaagcgccgacgctcccctgagcggcagccttcagataccagtacatcgcttgcttatagtcctggtccaccccttcgccagcgttataatcccatgcaatttgaaactgggcgtgccgattaccctgctgtgcgcttttcaaataccagaatgcggcgagtgtcttgttttgagcaacgccttttccgtcttcataaagatcggccagattgttttgcgcgtcactatggccttgtaatgcagcttgtttgtaccagaaaaatgccagcgcatagtcttttgcgactccgttgccatttctgtacatccacccaagattattttgcgcataagacattccgctctccgcggctatctgataccagacaaccgcttctttataattgggggcttctccacgatccagtgtccagccaagggcgttggaagcgaaagtatggccttgtagggcagcttttttcagccagaagatggcttgctcattatctttatgacggcttttatcctcggtatacttttgccctaaggaatactgtgcttcacaatgaccttgctcagcggccagcttcagccagtaaaaggctttttcgtcgtccggagaatcaattgcgctatcgcgattataataaaacccaacaatatattgagcctcgcaatcgcctttttcagcacgttcgataatctcatctattgataaattatcgcagcaacttgacgtgaaaatcattatcatttccttatggttgcagataaaacatattatatttttatgtgttccatttttgcgtaagccttattttatgcgtattatgtcgcgtcagaaaagtataaataaacgagcctcgcaatgcggctaatattcatttaatgaatatttaaggataaattatatggacatggagtcgcaaaaaatattgtttgcactttccactccgatggaaatacgcaatgaatgctgtttaccttcgcattcatcacccaaaatgtatttaggtacatgcttttttgacctttcttcctcatggggaattgatgaccgtgatgacctgctgcgcacaattcaccgaatgatcgataacggtcatgccgctcggttggcagggttttatcaccgctggtttcgttattcgccatgtgaatggcgtgactatcttgctgaactaaatgagcaaggtcaggcttatgcgcaatttgtcgccagcaccgccgaatgctgtggcgaagggggaatcaaagcctgggattatgtccggatgggttttttaagccgaatgggcgtacttaataactggttgagcgaagaagaaagtctatggatccagtcgcgcattcatctacgggctctacgttattatagtaactggcggcaatactttgccggttatacctttggtcggcaatattggcagtctcccgaagatgatcatctgcctttattacgcgaattcttagcgcgtaaagaatacgacgattccggcaatgatatgttttatcaattatttgccagtgatgatgcgtattaccctaccttgtcctggcaaccattggcttactattctgcatgcccggaaacgcttaaggatatgagcgacctatgaaaaattgctggaagatcctcgatatagaggaaacgactgacgtcgatattatccgccgcgcttatctggcgctgttaccgtcctttcatccagaaaccgatccgcagggttttaaacaacttcgtcaggcgtatgaggaggcgctacggattgcgcagtcgcctgctaaatctgtttggcaaccagaagaatatgaggtagcagaacatgaaattctgctcgcctttcgtgcgttacttgcctctgatagtgaacgttttctgccctccgcctggcagcgattcattcagcaattaaattattgctcgatggaggagattgatgaattacgctggtcgctgtgcacaatcgccatgaacactgcccatttatccttcgagtgcgtggtgttattagcagaaagattgcggtggttacaggaggaaaataccggggaaatagacgaagaagaactggaatcctttttatatgccattgcgaaggggaatgtttttaacttccagaccattctgcatctgcccgttgccgtgcaaaatgacaccatcgatttttaccaaatgttcgctcggatttggtcatcgcatccacaatggctgacattgtatttagcgcaacatcgcgcagtgattatccccgatgatgcaaaactgcacagaaatttactccgctggtatagcgcaggtcgcctggatatccccgaacttctggattacgcccagtcatggcgggaaactgaacctgataatgaagatgcgccttattatgaatacgcgcaacgcgtctattgtggagaaggcgaaagcctgttggcagaactttgtgactactggcgcgagtatccctccacccaggcggatgctttaatgttgcaatggtgccgtcagcatcgggtcgattattacccattactggtgatgatgattgaagcgcgtgatctggttaacgatcagggaaaaccgctactttatgtccccggcgacagcgcccgtacgcgttttcatttatacgaaatactcagcgatgaaaaactctctgcgctggggcgttcactggtcgagatggttttgcacaaaggacgtaagccgcggatctcactcacgcgtgatacagaacataccttatggccattatatctagttgccaaacaattagtgcaggcctgccaacctacagaagaatcattaatgccgattgtgagccgccttgatgcagaaaatcgttgtccactggaagcattaattattcgtcgattattaattcaggcggcgaattttaccgagaagcaaactgttgaaccggagccgcaaccgcagccaatgcccgttgacgatggtgggccaggctgtctgggcatcattaaaattattttctatatttttatctttgctggtttgatagggaaaatactccatctgttcgggtgacagtcgacgttaatgtgcgggaagcccggcaagtaatctttccgcatttttgtaatgttgtttggcggtcagttttaaccatttttgagattcataatggttaacattaatacctgagccatttctgtagatcaaacctaaagtatattgagcatgagcatacccttgttcagctgcttccttataccagagaattgctttacgggtgtcgggtttgacccccagacctttgaggtagatccaccccagtttactttgcgcgcgtggattttcctgttccgctgattgctcataccagtatctcgcctgtgtataatccagtggtttaccgtcgctaccatgaagataaaattctccaaggcgatattgcgacgttgagtgaccatgaatcgcggaaagctccgtggctgccgtggtgaatggaagactgcccggtgagcttaaataatcaaaggcataattcaccatggctttatcacgcaacgtcgttttcttgggttggctaatacaggtaattgctgcaactataaaaattgcgaatatatacattaattttttattcatgtgtgaatgcttcgattttctttttattttgaaagcgtcaagtttatactcatcaataataaaaaagtagtcagttaatgcacttaagggattattaacaaatgaataaggaagaacaatatcttctttttgcgctttctgcgcccatggaaatacttaatcagggttgcaaacccgcgcatgactcgccaaaaatgtatactgggataaaagaattcgagctctcatcatcctggggaataaataatcgtgatgatttaattcagactatttatcagatgactgatgatggtcatgccaatgatttagctggcttatatctgacatggcatcgctcttcccctgaagagtggaaagcattaattgctggtggctcggagagagggttgatttatacccaattcgttgcccaaaccgctatgtgctgtggggaagggggaatcaaagcctgggattatgttcgaatggggtttctgtcacgggtcggtgtgctcaacaagtggctgacggaagaagagagtttatggctgcaatcgcgcgtctatgtacgagctcaccattactatcacagctggatgcactatttttccgcctattcgttaggacgtctctactggcaatcttctcagtgcgaagacaacacttcgctacgcgaggcgctaaccctgtacaaatacgatagcgccgggagtcgtatgttcgaagagctggcagcgggaagcgatcgtttctatgccacgcttccctggcagccattaactgtccagtctgaatgcccggtaacgcttaaggatgtgagcgacctatgaaaacatgttggcaaatcctcgaaattgaaagcacgacgcaaatagacattatccgccaggcttatcttgctcgcttaccgttgtgtcatcccgaaaccgatccgcaagggtttaaagcattacgccaggcctatgaagaggccctgcgactggcggtaaatcctgtcgaggaagcagatgatgaagaaaaagatgctgccgctgaacatgaaatactacgtgcattcaggacattactggattcagaaagtgatcgttttcagccttccgcctggcagaaatttattcagcaattaaatacctggaacatggaggatgtcgatcaattacgctggccgctgtgtgcaatcgccatagaagcgcgatatctttcattaaattgtgcttctttgctggcagagcgtttgaactggcattcatttaatgacagcgaaggaatggatgaggaagaaagggaggcttttcttgaggccattcaggctggtgattgtttcgatttccttagccttctggaatatcccattgcgttgcagaaccagactgttgagtattacttcgcgctggaacgttgctgccgttaccatcctgactatgtcactgcgtttttggcgatggaaggtccgtggttaattcctgatgatgcaaagttacatcgcaaactgttgcgctggtacagctcggtgcaaacaggtatggcggaactcattcctgtcgctcaacagtggcaaacggaagaaccagaaagcgaagatgcccggtattacttgtgtgcacaacgtttgtactgcggcgagggggaaagcctgcttgccgatctctgcgcgtactgggaaagttacccatctacacaagctgataatttgttgttgcagtggagcaagcgtcattgcccggattatttcgcgttattagtgatggttatcgaagcgcggagcatggtagatgcgcaaggtcaaccgctgaaatatgttcctggtgagagcgcccggacgcggctgttatgggcggagattttacatagcggaaaattatcgccgttaggtcaatcgtttattgagtcgttattcttcaagcgcaaagcatgggcgtggtggaaatcgagagtcggtagcgagacagagcaagattcaccgttcctggatttgtatcgggtagcggaacaggtagtacttgaagcgtttccgaaacaagagatgctggcccgtcttaatacaaggctggaaggcggagatgctcatccattagaggccattgtcacccggatgcttttgacgaaagtgaaactcgagccggaggatgaagatgtcgatgagccaacacctgaaaatcatgaagaaaaaaatgatgagggtgaaaaaccacagagcattaccagcattatcaaaatcagtttaacggtgctggtgataggttatgctctcggcaaaatcgcgatgttgtttagctgacgatgtgttttttgcgccgatgccggatgcagcgtttacgccgcatccggcagccgtgtttatgggatctcaatggctaaataatcgctcgcccgccgccgaacttcatccacgcgggccatatcgtttgactgcaacgccgcatcaaaatcggtgatcacccggccgatctcttctcgctcgtcacccagcgcccgcgcccacaactcttccagtttggctttaaaggtgcgattgatgagcatatcgcgcggataaattttcaatgcggataaccgcgtccgactctcttcaatctgctgcgcgctcaatgttaccgggctgtggttaatcactctggacttaacgctgccgtcttccagaagcacgtcaacttcaagcaacccgttgatatcataactaaagcgaatatcaatcgactgataagccccggttttcttcaacggcacatcgaaggattccaccagaatgttgtttttaactttgtggttttctccctgatagacgttaaccgtaattgaatcctgttccgggtgcatggttgaataagtttctacacgcgacacgggcacagtggtgtttcgttcaataatcggcgagaaaatgccggaaacgccctggcggttaacttcaacgcccaacgagtaagggcaaatatcagtgaggattacctcttcaatatcttcactgcgtaagcggcaggcggcctggattgctgcgcccagcgcgacaatggtgctcggatcgtaactttgatacggtaatttgccaaacagacgcacggcgattcgctgcaccagcggcatttgtgacgcgccgccaaccagcaccagactgtcgatttgactcggcttcagacgcgcatcgcgcaacgcctgttcaatcggcactcgcaagcgattgagcagcggcaaccacaaatcttccagttcgttctcgtaaaattcgcattcccgcgtttcttcctgatactgccagcgaatgtgcaatggcgattgattgctacattttgccgcttccacacaggcgtacaaggctgccagttcactctcgttaagcgtggtcctggcgacatccgcgcgttttaaaacctcatcgaccagcatatgggtaaaatcttcgccaccaagaaagttgtcgccagcggaggcgtgaacttcaatcaccggcgtggcgtactcaagcaccgtaacgtcaaacgtgccgccaccgagatcaaacaccagcgaacgggtattttgttgggtatgcaggccatacgccatcgcagctgctgtgggttcattaattaagcgtaccgcatttaacccggctaactccgctgctaaacgggtatgcttgcgttgttcatcgctgaaataagccggaacggagatcaccacatctttaatcggacgttgcagaaattcttcggcatcttcttttaatgagcgtaataccaaagaggacagttctggcgcgttaaatgtgtcgctgcctaaccgccagttggtattactgcccattgcacgtttaaataacgctgccgttttatccggatgcgaagtacgccgtgatacagccggttttccgactaaaatatgattattttcatccatgctaattatggatggtgttaaatattcaccgaacttatttggaattaattgcgcggcaccgtctttccagacggcaattaaactattggtagtaccgagatcgataccaatggcgagttctgcattatccattgcatttatatcttgaaagaaaaagagataaacagattaagaccacccaggtaacgcgtggtgatcttaatcaatgacgtgtgttaagcgtaaaatttcagacgatcagccagtaaatcaacaaagccctgacgatcaacatcgaccattacggtggcattcggtttattgcctgtcagataataataatcaacaaccgtcataccctgggtatatttcccctgtgtttccacgccaacccagcgctcaacagaggtaaataactccggtttcaacagccaggcgatggtgcatgggtcatgcagtggtgcgccgacaaagccccatttttcgtctttatgatattcgaggaagaaatccagcagttcggcaacaatggttgaaacagggttaccaatcgcgcggaaacgctcggtgtcttcaacgtggatttgtgctttatgagtaacatccagaccggccatcaccaccgggatccctgactggaagacaatttctgccgcttccgggtcaacgtaaatattaaattcagccgcaggcgtccagttacccagccccatagcgccacccataatcacgatacgggcaattttgctatgcagttccggatggctattgagcagcaaggcaacgttagtttgcggtccggtagacacaatggtgacaggttccgcactttcacgcagcgttttcgccatcagctctaccgccgtacagttttgcggtgcgaatgtcggttccggtaatgccgggccgtcgagaccgctttcgccgtgcacattgtccgcgataatcaactcacgcattaacggttttaccgcgccgcctgctaccggaatatcggtgcgattaagcaaggtcagcatacgcagaacattgcgtaaggttttttctggtgtctggtttccggcggaagacgtaattgctttgacatcaagctctggtgaggcgagggcgagaactattgcgatagcgtcgtcatgacctgggtcgcaatctaacagaattggcagtgccattgttgctccttgttgtgtgcttctttgcgacaagggtaacgccaggatgtaacagatacgaggggcgaaacgataaagcgtgagatggcgcgcaattgggtatgcgcgccagagtgattaatgcaggattttcgcgaggaagtcttttgcgcggtccgatttcggatcatcgaagaaagcgtctttcggcgagtcttcgacaattttaccctcgtccataaagatcacccgattcgccactttacgggcaaagcccatttcgtgggtcaccaccatcatggtcattccttcgttcgccagttccaccatcacgtccagtacttcgttgatcatctccggatccagcgccgatgtcggttcgtcaaacagcatcgcaataggatccatacacaacgcgcgagcgattgccacacgctgctgctgaccgccggaaagctgcgccggaaacttattggcgtgagcagaaagcccgacacgctccagcagtttcagggctttttcacgagccggcgctttatcgcgtttaagcactttcacctgcgccagggtcaggttttcgataatcgacagatgagggaacagctcgaaatgctggaataccatcccgacgcgggaacgcagctttgccagatcggttttcttgtcgttaaccacgataccatcgacggtgatttcaccttgctgcaccggttcgaggccgttgacggttttaatcagcgttgatttgccggaaccagacgggccgcaaaccaccaccacttcgccttttttcacttcggttgagcagtcggtcagcacctgaaagtgaccataccattttgaaacatttttcagggtaatcattatgctgtccttcttttcaagtagctgaccaacaacgacgcgctaagactaataacgaaataaacaaatccggcaaacaggatcatctcaacctgcgtaccatcacgctcaccaatggttgaggcggtacggaagaaatcggccagggataacacatacaccagtgaggtatcctggaacagtacgatgccctgagtgagcagcagcggcaccatcgcgcggaacgcctgcggcagaataatcagtttcatcgactgccagtgagtcattcccaacgccagcgcggcgctcgattgaccacgagaaatactttgaataccagcacggataatctctgaatagtaggccgcttcaaacatcgaaaacgccaccatcgccgaaattaaacggatatcattttttggcgataatcccagcacgttttgcagaaaacccggcacgatcaggtaaaaccacagcaaaaccataactaaaggaatcgagcggaatacgttaacgtaggctttggcaaaccacgccacgggcgcaaagctggataaacgcatcaccgccagcatcgtgccccacaaaataccaatcactaccgccgtgacggtgattttcagggtgatcaccagcccgtcgagcagatatggcagggaagggacaatggaactccagtcaaactcgtacattatttgccccccatgttgccaggcaggcgaactttacgttcaaccagcgtcatcaccagcatgataaaagcgttaatcaacacatacgccagcgtaatggcggtaaacgactcccaggcatgggctgagtaatcgagcaatttacccgcctgcgccgccatatccaccagaccgatagtcgaggcgatggcggagtttttcaccaggttcatcatctctgaggtcatcggcgggacgataacgcgataagcattaggcagcagtacgtatcgataagcctgcggtagcgtcaggcccatcgccagcgcggcatttttttgccctcgcggcagcgactgaatcgcggcgcgtacctgttcgcaaacacgggcggcggtaaacagccccaggcagagcatggatgaaaggaaaaactgaatattgggatccagctcggccttaaaccacatgccgattttctccggcagcagctccgggatcaccagataccaggtaaagaattgcacaatcaacggcacgttgcggaacagttcgacatacaacgtacccagaccagagagaaaacggtttggaacggtacgtaaaatgccgaaaaatgaaccgacgaggaaagcgataatccaggcgcagatcgacaaagcgatcgtcacctgaaaaccactccagatccaaccaagataggtggtgttgccgaacggggcttgttgtaaaaaaataccccagttccagtctatagacataaatctactccagaaaaaagagggtagcagcgttaactgctaccctcgaagattgttacccagcgtattgcggttttcaggcccgatggggaacgaccatcaggcgtatagtctgtccgtgctacgtaacaatcgagagggctggaatttccgcccctggttcttgtaattagttcagtgccttgtcattcggttctttgaacagtgctttcatttcgtctgacagttcgaaattcatgttcaggtttttcggcggaattggatttttgaaccacttatcaaaccatttttccgcttcaccggaggtctgcacctgagcgatggtgtcatccatcagctttttgaactgcggatcatctttacgcaacatacaaccgtaggcctcctgagactgcggcttgccgacgatttcccagttgtctggtttcttcgctttcgcacgttcaccggccagcagagcgtcatccatcataaaggcaacggcacgaccgctttccagggtgcggaaagagtcaccgtgatctttggcgctgatgatgcgcatattcattttttgctcttcattcagtttgttgagcaaaacttcagaggtagtgccggaagtgacgactacggctttgtctttcaggttggcaaaatctttgatatcgccaccctttttggtcaacaggcgcgtaccgaccacgaaaatagtgtcagagaaagccgcctgtttttggcgttcgacgttgttggtggtagaaccacattcaaaatcgaaagtgccgttttgcagcagtggaatacggttttgtgaggtaatcggaatcagttttacctgcaagtccggtttgttgagtttctttttcactgcttcaacaatggcgttggagtaatcctgcgagtaacccaccactttttgctgattgtcgtaataagagaaaggcactgaagattcacggtgaccgacgacaatcacaccgtttttggcgattttgtccagagtactgcccgctgccggggcggcgtcatctgcctgtgccagtcctgcggaaagcgccagggcgaggattgctgtggcaggtttacgtaattgcatatccaactcctttatcttctgcgttaagaacgcatggatacccgttgtgagtgtttgtgttgttatcgtctgcaactttattgtgcagtgttgtgcctgttagggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccttaggtaacatttagtttggctaaatgtaaagatattgctgttttattgtttgtttttgcgagatgcgccgcaccattccgaagcaaaattcttaaaatgcactcttttagtgctaccgctggattactgtggtgcaactaggttgtactgatgctgtttcagggtttgccttgtataacaaagcaatagatgtgccaaagttggataggagaatattgttatccggataatgcactgatgccgcatccggtgagcgtgccgaaatatgggatgtattccggcacgataagaagggattatttacgtcgctgacgcagactcatcaacacagcagcaaaaccaaacaatgccgtcagcacccacagcggccagttgccggtacgtgcgtatggtgtgagtccggtggtcggcgtcacgttagtggttaacacctcgcgggtgaactgcgggatcatcgcctgaatctcaccctgcgggccaatcaccgccgtaatgccgttgttggtgctgcgcaacagtgggcgcgccagctccagcgcacgcattcgcgccatctggaagtgttgccatggaccaatagatttaccaaaccacgcatcgttggagatagtcagcagatagtcggtatccgggcggaagttatcgcgcacttgctcgccgagaatgatctcgtagcaaatagccgcagtaagctcaataccatttgccgacagcggcggctggatatatggcccacggctgaacgacgacatcggcagatcaaagaacggtgctaacggacgcagaatcgactccagcgggacaaactcgccaaacggcaccagatggtttttgttatagcgatcggctgattcgtagctgtacggcgcacctttacccagcgtgatgatggtgttgtaggtatcgtagcggttctgcttattgagacgcgcgtcgacaatcccggttaccagcgagctacctttatcacgcaactcaccgtccagtgctttgaggaacggttgctgattaatttccagatcggttatcgccgactccggccagataatcaacgatgatttgcccatcagcggtgccgttgcgttgtagtaaatcttcagcgtattaagaagctggccttcgtcccatttcagcgattgcggaatatcgccctgaaccatcgaaacctgaatggttttctccggttgtggggtaaaccactggatgtaacgcagcgggaagggaagggcaaacagcacgacggccaccaccagcggacgccagttgcgtttgaccaacgccagtgccagcaggccactaaccatcatcagcaggaagttaatggcttccacgcccattatcggtgccagcccttttaacgggccatcaatctggctatagccgaactgtaaccacgggaagccggtcagtacccaaccgcgcagaaactcggtcacttgccagagggcaggggcggcaatcgctacgcgcagccaggtggttttcggccacagacgcgacagcacgccagcaaacagtccggtatacagcgacaaatacgccgccagcagcaccaccaggaagatgttaaccgggccaggcattccgccaaaggtcgcgatgctgacatagacccagttaataccgctgccaaagaggccaaatccccagcaaaagccaatagcggcagactggagtggacggcggttaaaggtcaacgcctgaagccccatcagcgaaataatcgccgcaggccagacgtcgtaaggagagaaggccagcgttccgcaggcaccgaataataacgccagcagcaggcgaatgcgctggcgttcaattaatgaggcaaaagccatgtagttatctatccagtttcggttttattcatccagcttcggctggggtgagtcatccgggattttgacatgaacctgaataatacgccgactgtcggccatcgccactttgaactggtaaccgtcgatgtcgatagtttcgccacgcgccggaagatgcccaaatgcctgcatcaccagaccaccgatagtgtcgacttcttcatcgctaaagtgggtgccgaacgcttcgttgaagtcttcaatggaagccagtgcgcgtacggtccaggtatgacgactcagctgacggaagtcgatatcatcttcttcgtcatactcgtcttcaatctcaccaacaatcagttccaggatgtcttcaatggtcaccagaccggaaaccccaccgaattcgtcaataacgatcgccatgtggtaacgctgagagcgaaactctttcagcatccggtctacgcgcttactttcaggaacgacaaccgcctgacgtaacactttgtccatgctgaaggcttcagcatcgctgcgcataaacggcagcaagtctttcgccatcagaatcccttcaatgtgatctttgtcttcgctaatcaccgggaaacgtgagtgggcggactcgatgatgacatcaagacattcgtccagcgtctggttgcgtttcagggtaatcatctgggagcgggggatcatgatgtcgcgaacgcgttggtctgcgatgtccatcaccccttcgagcatatcgcgcgtatcttcgtcgataaggtcgttctgcccggaatcacggatcagcgccagcagttcgtcacggtttttcggttcaccgtggaaaagttggctgagtaacagggagaaaaatcccttcttgttgcttatcgtgtcactactgtgtgaattgtcgtcgctcatggcgtcgtatgggttctcatgttagttaatcaaaacgccgtcgttaatcaccaacggcggggacgtctgccagtcaaatgcctggcaaattattctttctcggcaatgtacggatcctcatagcccagagcaagcataatctctgtttcgagggcttccatttcttctgcttcgtcatcttcgatgtgatcgtaacctaacaaatgcagactgccgtgcaccaccatatgcgcccagtgcgcctccagtggtttgccttgctcctgagcttccttctcaaccacctgacggcagataaccagatcgcccagtagcgacatttccatgccaggcggcacttcaaacgggaaggagagcacgttggtcggcttatccttaccgcgataggtcagattcagactgtggctttcggcggtatcgaccacgcgaatcgtcacttccgattcttcctgaaactgcgggatcaccgcattcagccatgtctgaaactggctctcttccggtaacccggaattatcttcacatgccagttgtaaatcgaggatcacctgactcatttttgttcctgttcttcgcgcttgcgttctgctgccagcgccgcttttcgtttttgttcggcttcttcccaggcttcataggcgttaacgatacgcgccaccacagggtgacgaaccacgtcttcgctgtggaagaagttaaagctgatctcttcgacatcggccagcacttcgatggcgtgacgtaagcctgatttagtattacgcggcaggtcgatctgtgtgacgtcgccggtgataaccgcttttgagttaaaaccgatacgggtcaggaacatcttcatctgttcgatggtggtgttctggctctcatcgagaatgataaacgcgtcgttcagcgtacgaccacgcatataggccagcggtgcgacttcaataacgttgcgctcaatcagtttctcgactttctcaaagcccagcatttcaaacagcgcgtcgtacagcgggcgcagatacgggtctactttctggcttaaatcgccaggcaggaagcccagtttctcaccggcttctactgccggacgagtcagcagaatacggcgaatttcctgacgctccagggcatcaactgccgcagccactgccaggtaggttttacccgtacccgccgggccaacgccgaaggtaatgtcatggtcgagaatattggcgatgtactgcgcctggtttggcgtgcgcggcttaattacgccgcgtttggttttgatattgaccgctttgccgtactccggcacgctctccgcgctttgctccagtacccgcgcttctttaatcgcaaggtggatctgttccggttcgatatcctgaatctgaccgcgcatcggggcagtatcgacatacaggctacgcagaatgtctgccgcagcggtgacgcaaatcggacggccggtcagtttaaagtggttatcgcggcgattgatctcgatgccgagacggcgttcgagctgcttgatgttgtcatcaaacgggccgcacaggctcaacagacgcgcattgtctgctggctccagggtgatttcgcgagtgtctatgttcaaaccgttcctcttatctgtatgccgccggaagctgaacattcaccggcctataaggaaattattcacgccacaggaaaaaggcgcaagcattgcaataaagatggggataaagagagaaaaaacaaggcccaccggaacggcaggcctgagaattacggctgataataacccacgccaaggtcgttttctttgcgggtacgggcaatcactgattccggtgtttctgccacgcgcagacccatttcatcttcagtacgcaccactttaccgcgcagagagttcgggtagacgtcggtaatttctacatcgacgaatttaccgatcatatccggcgtgccttcgaagttgaccacgcggttattttccgtacgcccggaaagctccatgatgctcttacgcgatgtaccttctaccagaatacgctgggtggtgccgagcatccggcggctccacgccatcgcttgctgattaatgcgctcttgcagaatatacagacgctgcttcttctcttcttccggaacatcatcaaccatatcggcggctggtgtacccggacgtgcagagaagataaagctgtagctcatgtcgaaattgacgtcggcaatcagcttcatcgttttctcgaagtcttcggtggtttcgccagggaagccaacgatgaaatcagaactgatctgaatatctggacgcgccgcacgcagtttacggatgatcgctttgtactccagcgccgtatgggtacggcccatcaggttcagaatgcgatcggaaccgctctgtaccggcagatgcaggaagctcaccagctccggcgtgtcgcgatacacttcgatgatatcgtcggtgaattcgatcggatggctggtggtaaagcgaatacgatcgatcccgtcgatcgcagcaaccagacgcagcagatcggcaaacgatccggtggtgccgtcgtagttttcaccacgccaggcgttcacgttctgaccgagcaggttgacttcacgcacgccctgagccgcaagctgggcaatctcaaacagaatatcgtcggacggacggcttacctcttcaccacgggtgtaaggcaccacgcagtaggtgcaatatttattgcagccttccatgatggagacaaacgcggtcggcccttcggcgcgcggttccggtagacggtcaaacttctcgatttccgggaagctgatatctacaaccgggctgcggtcgccacgcacggagttgatcatctccggcagacggtgcagcgtttgcggcccaaaaataatatcgacatagtgggcgcgctggcgaatgtgctcgccttcttgcgatgccacgcagccaccgacgccgataatcaggtctggattcttctcttttaacagtttccagcgacccaactgatggaagactttttcctgagccttctcgcggattgagcaggtgttcagcagcagcacatccgcttcttccgccacgtcggtcagttgatagccgtgggtggcatccagcagatcggccatcttcgatgaatcgtactcgttcatctgacagccccaggttttaatatggagttttttggtcatcgacttgctcttgcgaaatagtagccaggaatgcagggcgcatagtgtaatgctttgctgccgttgtgaccagtatgagcgttatcagcccttaggggtaaaaatcctgtaaacttaaagcatattgctaacaggatgattgaccatgacaaatcaaccaacggaaattgccattgtcggcggaggaatggtcggcggcgcactggcgctggggctggcacagcacggatttgcggtaacggtgatcgagcacgcagaaccagcgccgtttgtcgctgatagccaaccggacgtgcggatctcggcgatcagcgcggcttcggtatcattgcttaaagggttaggggtctgggatgcagtacaggctatgcgttgccatccttaccgcagactggaaacgtgggagtgggaaacggcgcatgtggtgtttgacgccgctgaacttaagctaccgctgcttggctatatggtggaaaacactgtcctgcaacaggcgttgtggcaggcgctggaagcgcatccgaaagtaacgttacgtgtgccaggctcgctgattgcgctgcatcgccatgatgatcttcaggagctggagctgaaaggcggtgaagtgattcgcgcgaagctggtgattggtgccgacggcgcaaattcgcaggtgcggcagatggcgggaattggcgttcatgcatggcagtatgcgcagtcgtgcatgttgattagcgtccagtgcgagaacgatcccggcgacagcacctggcagcaatttactccggacggaccgcgtgcgtttctgccgttgtttgataactgggcatcgctggtgtggtatgactctccggcgcgtattcgccagttgcagaatatgaatatggcacagctccaggcggaaatcgcgaagcatttcccgtcgcgtctgggttacgttacaccgcttgccgctggtgcgtttccgctgacgcgtcgccatgcgttgcagtacgtgcagccagggcttgcgctggtgggcgatgccgcgcataccatccatccgctggcggggcagggagtgaatcttggttatcgtgatgtcgatgccctgattgatgttctggtcaacgcccgcagctacggcgaagcgtgggccagttatcctgtcctcaagcgttaccagatgcggcgcatggcggataacttcattatgcaaagcggtatggatctgttttatgccggattcagcaataatctgccaccactgcgttttatgcgtaatctcgggttaatggcggcggagcgtgctggcgtgttgaaacgtcaggcgctgaaatatgcgttagggttgtagccttacaacattgccggatgcgtgccaaccgtaggtcggataagacgcggcagcgtcgcatccgacattgaaggataagacgtgtcaacatcgcattcgacattgaatgaacgcagaaaagcaaaaagctcgccgaagcgagcttttttaatgtggctggggtacgaggattcgaacctcggaatgccggaatcagaatccggtgccttaccgcttggcgataccccaactgggtgcacttacaaggtaagcgtcttgaataaattggctggggtacgaggattcgaacctcggaatgccggaatcagaatccggtgccttaccgcttggcgataccccaacaaattggttttgaatttgccgaacatattcgatacattcagaatttggtggctacgacgggattcgaacctgtgaccccatcattatgagtgatgtgctctaaccaactgagctacgtagccagattgtttcttcgatggctggggtacctggattcgaaccagggaatgccggtatcaaaaaccggtgccttaccgcttggcgataccccaataaccgggcggtgaaccgcttactcgaagaagatggctggggtacctggattcgaaccagggaatgccggtatcaaaaaccggtgccttaccgcttggcgataccccatccgtacaacgctttctggtgaatggtgcgggaggcgagacttgaactcgcacaccttgcggcgccagaacctaaatctggtgcgtctaccaatttcgccactcccgcaaaaaaagatggtggctacgacgggattcgaacctgtgaccccatcattatgagtgatgtgctctaaccaactgagctacgtagccatcttttttttcgcgataccttatcggcgttgcggggcgcattatgcgtatagagccttgcagcgtcaacctctttttcaaggaaaattgctcgaaagtgactgtttggttaggttgcgaacagcgtggcgctatattcgtcaattattgtttactttgtgttttttcccaccctacagccattcttttgtcatacaggatgaaattcggaatttaacaatagtggtgggaaattaatctatgaaatactggcctacagtgatgagttgtcaaacagtgatgtggcaaacccggaacatttccttactgcatatcagaatcaacaagcacctcaataactgaaacagccccggatttcaccggggctgtttcgcatttcttacttatacgccgactggtgaacaccaaccgcgcgaccagacggatcgtccattttcttgaacgcttcatcccattcgatcgctttagcggaagaacaagcgacggaaggaccgcccggcacgcactcagcggcgctcggaagcgggaatagttcttcaaagatctcccgatacaagtacgcttctttagaggttggcgtgttgtacgggaagcggaagcgggcagtttccagttgctgatcagaaacctgctgcgcagccacttctttcagggtgtcgatccaactgtaaccgacgccatcggagaactgctctttctgccgccaggccacgcttgcaggcagatacgcttcaaaacattcacgcaggatgtgtttttccattttgccgttaccgcacattttatcctgtgggttaatacgcatcgccacatcaaggaattttttgtcgaggaacggaacgcgtgcttccacgccccaggctgacatcgctttgttggcacgcgcgcagtcatacatatgcagggccagcagtttacgcaccgtctcttcatgcagttctttggcattcggtgctttgtggaagtaaagataaccgccgaacacttcatcagaaccttcaccggacagcaccattttaatgcccatcgccttgatcttacgcgacattaaatacatcggtgttgaagcgcgaatagtggtcacatcataagtttcgatgtggtaaatcacgtcgcggatggcatccagaccttcctgtacagtgaagtgaatttcgtgatgcaccgtgcccagatggtttgccacttcctgggctgctttcagatccggtgaacccggcagacctacagcaaaggagtgtaactgcggccaccaggcttcagagcgttcctgatcttccacgcgacgggctgcgtatttcttggtgatagcggaaataattgaggaatccagaccaccagaaagcagcacaccgtaaggcacatcagacatcagatggcttttaactgaatcttccagtgcctgacgcagctcgtttttgtcggtcacgttatctttcaccgcatcgtagtcgaaccagtcgcgatgatagtaagaacggatttcgccgtcctggctccacaaatagctccccgccgggaactctttaatcgtgcggcaaactggcaccagcgctttcatttctgaggccacatacagctgaccgtgttcgtcataccccatatacagtgggatgatccccagatggtcgcgaccaatcaggtaggcatctttttcgctgtcgtacagtgcaaaggcaaacatgccctgcaagtcgtcgagaaattccggccctttttcctgatacagcgcgaggatcacttcacagtcagacccggtctggaactggtaacgatcgccatattcggcgcgcaatgcctggtggttgtagatttcaccgtttaccgccagtacgtgggttttttgttggttgtagagaggttgcgcccccgcgttaacgtcaacaattgacagacgttcgtgggcgagaatggcgttatcgctggcataaataccggaccagtccgggccacgatgacgcatcaggcgtgacagctcgagggctttcttacgcagctcaactgcgtctgttttgatatcgaatacgccaaaaattgaacacataaccttctccgttaacctggtatttgttgcttgttgtgtttgcttgtttaaaaaaatgccgcaaagcagcactgtgcgcaagcgatttggcggtgaaaaaataaaaaacgtaatggtgattgtcgattggtgaaaaaaggtctggtgtgaggatatatttattgatgaatcgataatttttagcgggttttattgaatgtttatattttacgggggccaaattgctgacaaagtgcgatttgttcatgccggatgcggcgtgaacgccttatccggcctacaaaagcatgaaaattcaatatattgcaggagctgcgtaggcctgataagcgtagcgcatcaggcagtttggcgtttgtcatcagagccaaccacgtccgcagacgtggttgctattcagataacgtcgatttcagcgactgacgggtaaatccagctggggcggaaaggcatactgtcgatatcgtcgagcgacgaaacaccagaaagcaccagaatcgtctccagacctgcctggaagccggccagaatatcggtacgcaggttatcgccgacaatcaccgtttcttccgaatgcgcctgcattttgtttaatgctgcgcggatgatccacgggctgggcttaccaacatagaacggtttgcgcccggagattttctcaatccctgcacacaacgcgccacaagcgggataaaaaccgcgcccgtgggtgtccggattggtggcgataaaacgtgcaccgttagcgacgaaataggctgctttatgcatcatgtcccagttgtaggaacgcgtttcgccaacaatcacgaaatcagggttcacatcggtaatagtgaaaccggctttgtacagttcatgaatcagtgcgccttcgcccaccacatacgctttcttgccttcctggcgacgcaggaaatcggcagtcgccatcgcagaggtataaaacacgctgtcaggtacatcgacacctgcggtggcaaagcggttcgccagatcttgcccagtctgcgaaggatagttggtcagcaacaccagcggcaggcctttatccataatcccgtgcaaaaattccgctgcacccggtacggcgacgttatcgtgcatcagcacgccgtcgatatcgcaaattacatttttaatggtcatggactacccagaatattgacaacaataagcgccactataaaagcacattaattttccagcaaatgctggagcaaaataccgttgagcatggcgcgttttaccagcgcaaaagcgccgattgccgagcggtgatccagctcagaacgtaccaccggcagattagtgcgaaacgccttcagcgcctgggtattaatgcagctttcaatagcagggagcagcactttatcggcttcggtgatttcaccggcaataacaattttttgcggattaaataagttgatagcaatggcgatggttttacccagatgacgaccgacatactcaattacttccgacgccagactatcgcctttgttcgcggctttgcagatagttttgatggtgcagtcgtccagcggcacgcggctctggtagccctgctttaacagattcaacacccgttgttcaatggcagcgttggcagcgatagtttccaggcagccaaagttgccgcagtggcagcgttcacccagcggttcgacctgaatatggccaatttcaccgacgttgccgttgcggccaataaaaatgcgcccgttagagataatcccggccccggttccgcgatggacacgcaccagaatggagtcttcgcaatcctgacttgcaccgaagtagtgctccgccagcgccagactacggatatcgtgaccaacgaaacaggtcactttaaaacgttcttccagagcttctaccagcccccagttttctacctgaatatgcggcatgtaatgaattttgccgctgtccgggtcaacaagccctggcaggatcaccgaaatcgcgatcagctcgcgcagtttgcgctggtagctatcaataaactgagcaatggcattcaacagggcatgttccagcgtttgctgggtacgttccggcagcgggtaatgttcttctgccagcactttgctgctgagatcaaacagagtgatggtggcgtcatgacgaccaagccgtacgccgattgcgtggaaattgcgggtttcggtgacgatggagatagcgcggcggcccccggtggaggcctgctgatcaacttctttgatcagcccgcgttcgataagctgacgcgtaattttggttacgctggcgggggcaagctggctttgctcggcaatctgaatccgcgagattggcccgtactggtcaatcaggcgataaaccgccgcgctgttaagctgttttacgagatcaacattacctatctgagcttgtccgcctggtgtcatactttctcttattgagttacgacctcgttaccgttaacgatggtcttggtgattttaaaatcaggtgtgaatgcagtcaggttggctactttacctgcggcgagtgtgccgagacgtttctcaacgccaatcgcacgcgccggatagagcgtcgccatacgtagcacttcatccagtgcgataccgcaatgttcgaccagattacgcacgccttcaatcatggttaaggatgaaccgcttaacgtaccgttctcatccacacaaagtccgttacggtagtatattgttttacccgcaaaaatgaactgttcaatgttggcacctgctggcgcggtggcgtcagtaaccagacacagtttgtcgcctttcagacgtttagcgttgcgaatgttggcgtaatcaacatgcaggccatcagcaataataccgcaataaatgtcagcttcgtcgaggatcgcgcccgccaggccaggttcacgaccggtaatatacggcatcgcgttgtacagatgggtggcaaaggtaatccccgcgcggaaaccggcttttgcttctttcaacgtcgcgttggagtgaccggcagaaaccacaatcccggcatttgccagtttgctgatgacttccgcaggaaccatttccggtgccagggtcactttggtaatgacgtcggcgttttcacacaggaaatcgaccagcgcggcatcaggcttacgcacaaaattcggattatgggtgcctttttttaccagattcagccacggaccttccagatgcagacctaacgcctgattcggatgttttgccaggtactcgcgcataacgcgcacgccctgtttcatcagctcatcgctggtggtgataagcgtcggcagatagttagtacagcctgatttctcattggctttctgcatgatttccagcgtttccacgctgaccgcttcagcggtgtcgttaaactgtacgccgccgcagccgtttaactgcacatcgataaaaccgggggagagaatggccccgttcagtgaacgttgttcgatctctggcggcagttccgctaccggacagacgcttttaatcaggccatcagcgataacaaccgcgtggtcatcaagaaattcgtggccggtaaagatccggccctgggttaatgcatacattctgacccccgattttaaaaaatattgccctgagcaaggagccagggcagggataacaattacagacctttgatattttctgcttctaattcattgaaatatcttaaagtcttaactttcagctccatggtggaaggttcatcgcacaccatgatcgctttcggatgcagttgcagacagctgatggtccacatatggttcacgcaaccttcaacggcggcctgcagcgccagtgctttctggctacccagcaccagaatcatcacttcttcggcatccagcagtgtaccaacaccgacagtcagggcatattttggcacctgattaacatcgttatcaaagaaacgagagtttgcgacgcgagtgtcatgagtcagggttttgatacgagtacgagaagccagagaagacgccggttcgttaaatgcaatatgaccgtcgttacctacaccgcccataaacagatgaatttttccgtaagaacggattttttcttcatactggcggcactcggcgtcgatatccggggcgttgccgttgagaaggttgatgttttctgctggaatatcaacgtgatcgaagaaattacggtgcataaagctgtagtagctttccggatgctctttcggcagaccgacatattcgtccatgttgaaggtgacaacgtgcttaaagctgacctggcctgctttatgcatttcgactaacgctttataggtggtcatcggcgtgccgccagtcggcaggcccagtacaaacggacgatcggcagtcggtttgaacgcattgatacgattgacgatatggcgagcagcccatttgccgacctgttcagcggtagtcagggggatcagtctcattattcacctcaataagtaaaatgtaagccgttggcggattaggcatctttaagcgtaacctggatttgcgcagacaggcgtcaatccgacctgattttttgaatgataaaataagttttctggtttagccagtaaaagggagtgataataacgatatttggtgacaaaactcacaaaagacacgcgtttaatttgcgatacgaattaaattttcacacactctgtagcagatgatctaacaatctgattacagaacatcggcagtacaatttgcagcaaaataaaaatacggcttgaaacgagccaaatagggttctcgtagggggaataagatgaatattttaggttttttccagcgactcggtagggcgttacagctccctatcgcggtgctgccggtggcggcactgttgctgcgattcggtcagccagatttacttaacgttgcgtttattgcccaggcgggcggtgcgatttttgataacctcgcattaatcttcgccatcggtgtggcatccagctggtcgaaagacagcgctggtgcggcggcgctggcgggtgcggtaggttactttgtgttaaccaaagcgatggtgaccatcaacccagaaattaacatgggtgtactggcgggtatcattaccggtctggttggtggcgcagcctataaccgttggtccgatattaaactgccggacttcctgagcttcttcggcggcaaacgctttgtgccgattgccaccggattcttctgcctggtgctggcggccatttttggttacgtctggccgccggtacagcacgctatccatgcaggcggcgagtggatcgtttctgcgggcgcgctgggttccggtatctttggtttcatcaaccgtctgctgatcccaaccggtctgcatcaggtactgaacaccatcgcctggttccagattggtgaattcaccaacgcggcgggtacggttttccacggtgacattaaccgcttctatgccggtgacggcaccgcggggatgttcatgtccggcttcttcccgatcatgatgttcggtctgccgggtgcggcgctggcgatgtacttcgcagcaccgaaagagcgtcgtccgatggttggcggtatgctgctttctgttgctgttactgcgttcctgaccggtgtgactgagccgctggaattcctgttcatgttccttgctccgctgctgtacctcctgcacgcactgctgaccggtatcagcctgtttgtggcaacgctgctgggtatccacgcgggcttctctttctctgcgggggctatcgactacgcgttgatgtataacctgccggccgccagccagaacgtctggatgctgctggtgatgggcgttatcttcttcgctatctacttcgtggtgttcagtttggttatccgcatgttcaacctgaaaacgccgggtcgtgaagataaagaagacgagatcgttactgaagaagccaacagcaacactgaagaaggtctgactcaactggcaaccaactatattgctgcggttggcggcactgacaacctgaaagcgattgacgcctgtatcacccgtctgcgccttacagtggctgactctgcccgcgttaacgatacgatgtgtaaacgtctgggtgcttctggggtagtgaaactgaacaaacagactattcaggtgattgttggcgcgaaagcagaatccatcggcgatgcgatgaagaaagtcgttgcccgtggtccggtagccgctgcgtcagctgaagcaactccggcaactgccgcgcctgtagcaaaaccgcaggctgtaccaaacgcggtatctatcgcggagctggtatcgccgattaccggtgatgtcgtggcactggatcaggttcctgacgaagcattcgccagcaaagcggtgggtgacggtgtggcggtgaaaccgacagataaaatcgtcgtatcaccagccgcagggacaatcgtgaaaatcttcaacaccaaccacgcgttctgcctggaaaccgaaaaaggcgcggagatcgtcgtccatatgggtatcgacaccgtagcgctggaaggtaaaggctttaaacgtctggtggaagagggtgcgcaggtaagcgcagggcaaccgattctggaaatggatctggattacctgaacgctaacgcccgctcgatgattagcccggtggtttgcagcaatatcgacgatttcagtggcttgatcattaaagctcagggccatattgtggcgggtcaaacaccgctgtatgaaatcaaaaagtaatctgctttatgcctgatgcgacgcttgagcgtcgcatccaacaatgacaagcggtggagatcttctctgccgctttttttttcatcaatcatccccataatccttgttagattatcaattttaaaaaactaacagttgtcagcctgtcccgcttataagatcatacgccgttatacgttgtttacgctttgaggaatccacgatgagtgaggcagaagcccgcccgactaactttatccgtcagatcatcgatgaagatctggccagtggtaagcacaccacagtacacacccgtttcccgccggagccgaatggctatctgcatattggccatgcgaaatctatctgcctgaacttcgggatcgcccaggactataaaggccagtgcaacctgcgtttcgacgacactaacccggtaaaagaagatatcgagtatgttgagtcgatcaaaaacgacgtagagtggttaggttttcactggtctggtaacgtccgttactcctccgattattttgatcagctccacgcctatgcgatcgaactgatcaataaaggcctggcgtacgttgatgaactgacgccggaacagatccgcgaataccgcggcaccctgacgcaaccgggtaaaaacagcccgtaccgcgaccgcagcgttgaagagaacctggcgctgttcgaaaaaatgcgtgccggtggttttgaagaaggtaaagcctgcctgcgtgcgaaaatcgacatggcttcaccgtttatcgtgatgcgcgatccggtgctgtaccgtattaaatttgctgaacaccaccagactggcaacaagtggtgcatctacccgatgtacgacttcacccactgcatcagcgatgccctggaaggtattacgcactctctgtgtacgcttgagttccaggacaaccgtcgtctgtacgactgggtactggacaacatcacgattcctgttcacccgcgccagtatgagttctcgcgcctgaatctggaatacaccgtgatgtccaagcgtaagttgaacctgctggtgaccgacaagcacgttgaaggctgggatgacccgcgtatgccgaccatttccggtctgcgtcgtcgtggttacactgcggcttctattcgtgagttctgcaaacgcatcggcgtgaccaagcaggacaacaccattgagatggcgtcgctggaatcctgcatccgtgaagatctcaacgaaaatgcgccgcgcgcaatggcggttatcgatccggtgaaactggttatcgaaaactatcagggcgaaggcgaaatggttaccatgccgaaccatccgaacaaaccggaaatgggcagccgtcaggtgccgtttagcggtgagatttggattgatcgcgccgatttccgcgaagaagctaacaagcagtacaaacgtctggtgctgggtaaagaagtgcgtctgcgtaatgcttatgtgattaaggcagaacgcgtcgagaaagatgccgaaggtaatatcaccaccatcttctgtacttatgacgccgataccttaagcaaagatccggcagatggtcgtaaagtcaaaggtgttattcactgggtgagcgcggcacatgcgctgccggttgaaatccgtttgtatgaccgtctgttcagcgtgcctaacccaggtgctgcggatgatttcctgtcggtgattaacccggaatcgctggtgatcaaacagggctttgctgaaccgtcgctgaaagatgcggttgcgggtaaagcattccagtttgagcgtgaaggttacttctgcctcgatagccgccattctacggcggaaaaaccggtatttaaccgcaccgttgggctgcgtgatacctgggcgaaagtaggcgagtaattttaagtttcgctatgccggatggggcgtttacgtcgcatccggcaaggaacagacaaacagtttcaaacgctaaattgcctgatgcgctacgcttatcaggcctacatgatctctgcaatatattgagtttgcgtgcttttgtaggccggataaggcgttcacgccgcatccggcaagaaacagcaaacaatccaaaacgccgcgttcagcggcgttttttctgcttttcttcgcgaattaattccgcttcgcaatttatccataaaataaatttaaaataacaaaacataattaaataaaatgtaaccgctttcatcttgctggaatttcacgcttttattcttctgcaagcctttcaaccgcaaacttaagccttgtaacaaaaatcatcaaaatatgtgcggttgctcatgttcttacattctggttacagaaagagattgataattcgcgtcgcgaaaaatagtctgttcctgtagtcagcgagacttttctcaacgctacttttttaatttttattttttcgctgttcacctttggtgcagcaatttatacgtcaaagaggattaacccatgcgtacgtttagtggcaaacgtagtacgctggcgctggctatcgccggtgttacagcaatgtcgggctttatggcaatgccggaggctcgcgccgaaggattcatcgacgattcaaccttaaccggcggtatctattactggcagcgtgaacgcgaccgtaaagatgttaccgacggcgacaaatacaaaaccaacctttctcactccacctggaatgccaacctcgattttcagtccggttatgctgctgatatgttcggccttgatattgctgcgtttacggcgattgaaatggcggaaaacggcgacagctcccacccgaacgaaatcgcgttttcaaaaagtaataaagcctatgacgaagactggtccggcgacaaaagcggtataagcctgtataaagctgcggccaaatttaaatacggtccggtttgggcgagggcaggttacattcagccaactggtcaaacgctgttagcgccgcactggagctttatgccaggtacttatcagggggcggaagccggggcgaattttgattacggcgatgctggtgcgttgagtttctcctacatgtggaccaacgaatacaaagcgccgtggcatctggaaatggatgagttttatcagaacgataaaaccaccaaagttgattatctgcactcctttggggcgaaatacgacttcaaaaataacttcgtactggaagcggcatttggtcaggcggaagggtatatcgatcaatattttgccaaagccagctacaaatttgatatcgccggtagcccgttaaccaccagctaccagttctacggtacccgagataaagttgacgatcgcagcgtcaacgacctttatgacggcaccgcctggctgcaagcgttgacctttggttaccgggcggctgacgtagtggatttgcgcctcgaaggcacctgggttaaggctgacggtcagcagggatacttcctgcaacgtatgactccaacctacgcttcctcaaacggtcgcctggatatctggtgggataaccgttctgacttcaacgccaacggcgaaaaagcggtcttcttcggtgcgatgtatgacctgaaaaactggaatcttccaggcttcgccatcggcgcttcctacgtttacgcatgggatgctaaacctgcgacctggcagagcaatccggatgcgtactacgacaaaaaccggactattgaagagtctgcctacagcctggatgcggtctataccattcaggacggtcgcgccaaaggcacgatgttcaaactgcatttcaccgaatacgacaaccactccgacatcccaagctggggcggtggttacggcaacatcttccaggatgagcgtgacgtgaaatttatggtaatcgcaccattcaccatcttctgatgcccgacgcggcaggttttgtgcctgccgcacgtttgaggaatttgctatgaaaaaactgattctcatcgccataatggcatcggggctggtagcttgtgcgcaatcaaccgcgccacaggaagacagtcgtctgaaagaggcatacagcgcctgtatcaacaccgcacaaggttcgccagaaaaaattgaagcctgccagagcgtgttaaacgtgctgaagaaagagaaacaacatcagcagtttgccgaccaggaaagtgtacgcgtactggattatcagcagtgtctgcgtgcaacgcaaaccggaaatgatcaggcggtgaaagccgattgtgataaagtctggcaggaaatacgcagtaataacaaataagtgagagctgtaactctcgcttttcttatttcccttgcataaaaaagccaacccgcaggttggcttttctcgttcaggctggcttatttgccttcgtgcgcatgttcatcttcgcggcaatcgccttcggcacagtgaccgtaaagatagagactgtggttagtcaggcgaatgccatgttttgcggcaatttcacgctgacgcgcttcgatggaatcatcactaaattcgataaccttgccgcagtcgaggcagatcaggtgatcgtggtgatgttgctgtgtcagttcaaatacggatttaccgccttcaaaattgtggcgggtgacgataccagcgtcgtcaaactggttcagtacgcgatataccgtagccagaccaatttcttcacccatatcgatcagacgtttgtataaatcttccgcactgacgtgatggttgtccggctcctgaagaacttccaggatttttaaacgaggaagcgttactttcaggccagctttctttagggcggtattgttatcagtcatgcggaatctgtcctgttactaagcggttcacttcattagaagaagtgacagaatttgctcttgagataatgcgtatcattatagaattgccacgcctaaatgaaaaccacaagtccctggcaaatattgttaataaaaacgtggcacagcttacatttacaacggcaaggccacttgaacaccgggacattgtacaggtacaacagcaaaagttacaaatttgtagcaattattttgattggcattatctattaatacggcgtagacatgagtctacgccgcatcacatcaggcattgagaatttcgtcgagatgcaactcttcagaaatctgtttaacccatttttctacacgttcagcggtcagttccggctgacggtcttcgtcgatagccagaccgacaaagtggtcgtcatctgccagaccttttgatgcttcgaaatgatagcccgcagttggccagtgaccaacgatggttgcaccgcgcggttcaatgatgtcgcggatggtgcccaatgcgtcgcagaaatattcggcgtaatcttcctggtcaccacaaccaaacagcgcaaccagtttgccgttgaaatcaatctcttcgagagtcgggaagaagtcatcccagtcacactgcgcttcgccgtaataccaggttgggatgcccagcagcagaatgtcataagcttccagatcttctttgctgctttttgcaatgtcatggacatcggcaacgtctttaccaagctgtttttgaatcatttttgcgatattttcggtattaccggtgtcgctgccgaaaaagatgccagtgatagccatgagtgaaataacctcttgaaacttattgaaatgggggtggaaaattgcccacggataaaggcaatcatagcagaacaggcagtcttgcggaatcagcaaacgagcaggactgcacactgtgctacatgaaagtggaaatttaaacgatgccctgactacgcagcgccgccagttgctgcattaacatctcttcgatcagttcgctacggctcatattgcgcgactccgccagctcgttcagcgcctcgacagcttccgcgttcagcttcagttcgacacgcttaaggccacgtactttgtcgcgttttagctggttgcgtttattaatacgcagctgttcatcgcgcgaaagcggattagttttcggtcgtcccggtcgacgctcgtgcgcgaacagatctaatgtcgtacggtccgtttgttctttggccatgatcttggtgacttcgggggaaacaatcagccaggcctctgcccggatggatagcgcgccataatacatcagcgcgatgagtcacgccaacgcccacgcgcggaaagcgacgcggacgctgggtttttaatcagttgcgttaatcattgagatagcgacggatagcgcgtaataccgcatccggtttttcagcatggacccagtgacccgcgcctgcaatcacatgcgcccgtgcctgtggaaattgagccagtaaatcatcacggtactgctcgctaacatacggagaattgccgccagggataaacagggcagggtgatcccatgccgggattttctcccaacctacaatatgcggatactgatcccacaataccggcacgttaaagcgccactccccgtcaacaaaagatttcagcagaaactgaatcaccccttcttcattaagatgctggcgcattattgctgctgcttgctggcgagtttgtgcgtccgattcactgaccgcgttgatagccgcaaaaatctcatcatgacggcgtacgtgatagtcgaccggcgcgatatcgatcgccaccagtttatcgatgcgatcggaggctagtgcagtaagtgccattaccgctttaccgcccatggagtgaccgataaatgttgctttgtcgatctgctgtgcatccagagtatcaacaagatcctgcgccatcgccgggtaattcattaccggatctctcggtgaaagaccgtggttacgcatatcaacctggatgatattgtgatcgtttaccagatcgcgagccagtacgccaaggttgtcgaggctgccaaacagaccgtggacaagaacgatgggagaattattgtgctggttttgtgcagtttgcgcgcggatattcaatttcatggcaaagttctttttttcgcgttgtcgggttagggtattatgttgaccattgtgccacagggctgcaacaaataaggtttattccgagtttttctgcaagccaggcttgacgctatccgctgccgggatttattcatatactcctggcgacttgtattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaaaacgttgcagacaaaggacaaagcaatggcaatccacaatcgtgcaggccaacctgcacaacagagtgatttgattaacgtcgcccaactgacggcgcaatattatgtactgaaaccagaagcagggaatgcggagcacgcggtgaaattcggtacttccggtcaccgtggcagtgcagcgcgccacagctttaacgagccgcacattctggcgatcgctcaggcaattgctgaagaacgtgcgaaaaacggcatcactggcccttgctatgtgggtaaagatactcacgccctgtccgaacctgcattcatttccgttctggaagtgctggcagcgaacggcgttgatgtcattgtgcaggaaaacaatggcttcaccccgacgcctgccgtttccaatgccatcctggttcacaataaaaaaggtggcccgctggcagacggtatcgtgattacaccgtcccataacccgccggaagatggtggaatcaaatacaatccgccaaatggtggcccggctgataccaacgtcactaaagtggtggaagacagggccaacgcactgctggccgatggcctgaaaggcgtgaagcgtatctccctcgacgaagcgatggcatccggtcatgtgaaagagcaggatctggtgcagccgttcgtggaaggtctggccgatatcgttgatatggccgcgattcagaaagcgggcctgacgctgggcgttgatccgctgggcggttccggtatcgaatactggaagcgtattggcgagtattacaacctcaacctgactatcgttaacgatcaggtcgatcaaaccttccgctttatgcaccttgataaagacggcgcgatccgtatggactgctcctccgagtgtgcgatggcgggcctgctggcactgcgtgataagttcgatctggcgtttgctaacgacccggattatgaccgtcacggtatcgtcactccggcaggtttgatgaatccgaaccactacctggcggtggcaatcaattacctgttccagcatcgtccgcagtggggcaaagatgttgccgtcggtaaaacgctggtttcatctgcgatgatcgaccgtgtggtcaacgacttgggccgtaaactggtagaagtcccggtaggtttcaaatggtttgtcgatggtctgttcgacggcagcttcggctttggcggcgaagagagtgcaggggcttccttcctgcgtttcgacggcacgccgtggtccaccgacaaagacggcatcatcatgtgtctgctggcggcggaaatcaccgctgtcaccggtaagaacccgcaggaacactacaacgaactggcaaaacgctttggtgcgccgagctacaaccgtttgcaggcagctgcgacttccgcacaaaaagcggcgctgtctaagctgtctccggaaatggtgagcgccagcaccctggcaggtgacccgatcaccgcgcgcctgactgctgctccgggcaacggtgcttctattggcggtctgaaagtgatgactgacaacggctggttcgccgcgcgtccgtcaggcacggaagacgcatataagatctactgcgaaagcttcctcggtgaagaacatcgcaagcagattgagaaagaagcggttgagattgttagcgaagttctgaaaaacgcgtaaacacatttaataaaaaaagggcggtcgcaagatcgcccttttttacgtatgacaaacacagaattgcctgatgcgctacgcttatcaggcctacgaggatggtgcaatatattgaatttaagcgattttgtaggccggataaggcgttcacgccgcatccggcaaaaacaacgaacactttgtcaacaaactgagtagctcaaggaaatcccaatgaagaccaacaggagtctggtcgtcatagtgtcactaattaccgccacattactgctgactgcatgcgcccaacctgaacaatcatcattagctggcgactggttactgacccctaaagataaaaccagaggattaacgggtagcattgcggtaaatattgcacctttccggtgtaagacaaattgccgtggtgataacttacctgataatacccgccgctggcagttgtcaggcgggaacgaaaaagaacttacttatcttcataatatgtcagcacaagaaaaggtcggtttaaatcccggttggcaatgctacacctcattttttatgcgggtttgccagggcaagcccggcactcgaccgatagtcaatgaggattatgtcagcgaaagcggattttttggctcgatgatgcatgtcgggattattgagttacgacgctgccagtcagaaaattgccagcaagaattgaaagcgataaatacacattaaaatagtgagtccgggaatgaaacccggacctgaacatgtcttattgcgtgaatgtttctttcatttgatactgcatttcccagagttcagtaagcgaaataacttttcttgttcttgcttcttcactttgtacccataagaaagggtagaacgtgaaggcttccgttgccgataattttattacgtcttctcgccattgctgccatcgtacattttcatagaaggtatctaaatcaccggataatgcccactgaagaaactcagaatatccaacttccagactttcccaattcagcgtatctggcgcaaaataataaacgcagccagtatcttccccaagatcgccaccattaagagcaaaaattacccctgcgacatcgtcagcgatgggtaaagcccgcacgcctgcgaattcagggcgttgtgtccaacttactggatctcgtggcaaccgggggtgaccagatcctgctatgcgtaactaaccattatcaatcagcagacctccggagccatagacaagcgcacccatcggtgattttgttgtcacctgtaattgataaagtgcggtttcggctaaatctttattaaccggtaagagttcggtatggtttgtggcgtcttttaaccagttctggattattggccaggctgaatcttcagtatttactaactgattcatttcacgcatcgctacttgctccttgtgtgctacggtgtcatttatgatgaggaattgtatggaacattttttaaatattaagttccttatatttgaataaaaaatgactttatccatacattgccacttttttcaaagcataaaccgatacccaataccggtttcagtaataaaatggcgaggccgggccggatcctgttccagtttttgtcgcagatgccccatataattacgcaaatagttgctgtgttcgatcgcgtttagaccctacatctgccggatgcggcataaataacgaactatttgccaacaaacagaaagggcgatcattcaatcgcccttttttactttgttttattaaccgtgtttatttttcagttcaaagcgtggtgataccagaccatacagtgtccaaccaaggaaggtcacgatggaaccgtacagcatggcttcttccccggatgagtacagcgcataaaagctatacatcgcgccaacaaaagcaacaaagtttgcaactttcgcttttgaggggggcacattagcgaccttctgaataatgactaatgccgccattgacagaatatacggaatgatattggtcaccacggccaggttaaccagcacgttgaactgactgtttagcgacgggctaatggtcatcagtgccaatccactctgaataatcacaatggtcaacattccctgcaccggtgcatccactttggttacacgggagaaaattttagggaagtagccttcatcagatgaagatttaaacacctgggcaatggtgaactgccagccaagtagcgaaccgcagcaggacatcaccatcagcgccataatgactttacccacttccggcgtgaacatctgcgcgaaggccagaccaaatggtgccgttgaatttgccagctccatatttggcacaatcccggcaatcacgttggtggagacgatataaatcaccgccgcacctaacgtaccgccgagtaccgcgattggcacattacgttccgggttttccactacatcagtattcgcacacgcagactccagaccaagaaaagcccacagcgtcatagcgatggaagaacctaccgcactgaagaacggtgcatgatgcggattccaggaatcaacgtacagcgtcgggctaaaccagaaccagccaataatgcacagaccgacgaccggaataatgaccccccacacggtaatgctactgatttgcccggtaatgcgcgcaccaccaaagttagccacggtacaaatccacagcaccccgatggtcgcaagaccaatctgcactggcgacaaactcgcgccgagcagttcggtgccgtaaccaaccgccgaaatagcaatcgcgacgttagcaatcagcagtgagacgccgtaggtatagttcgccataaagttaccggatttaccgaaagcatactcggcataaccgcccataccgcctgatttacggctgaacataccgcattttgcgaatgcccatgccagtgccattgagcctacggctgtcaccagccaggagataattgagattgtcccgacttcggcaagctttgtcggcagcatgatgataccggagcccatcatgttgaccatcgtcagtatggttaactgaacgacgcccattttgttcgatttagcctgactcataatttttcccctttcaacagggtgctttgcgcatcacgaggcttgatgacatagcaccaaacttgcttacgaccatcatgttcttcgatatagacaccctgcagctccggtgcaaaacctggcagcaggttgatcccttcttccagagcgctgaagtaacgcagaacagcaccaccccagatttcacccggaacaacacacagcacacccggaggataaggaagcgcaccttcggcagcgatacggccttctgcatccggcagacgaaccagttccacttcaccgcgtaaataggcgtagttggcttcttgcggattcatgctgacgcgtgggaagtgctccttacggaacatctctttttgcagttgtttcacgttgtggcgggcatacaaatcatgcatttcctgacacaactgacgcagggtataaccggcgtagcgctcttcatgctgtttgtagatggaaggtagcacttctgctaatggcgcgtcggactcaagcagtttttcgaagcgtaccagcagggcaacaagttgctgaagtttggccatatcttctgccggagtcagcaggaagaggatggagttaagatcgcatttttccggcactacgccattttcgcgcaggaagttagcaagaatcgtcgcgggtacaccgaacgcttcatattcgccgttacgtgcatcaatacctggggttgtcagcaacagtttgcatggatcgacaaagtattgattctctgcatagccttcaaaagaatgccagtgttcccctggtacaaactggaagaagcgcagatcaaccgcaatttgcgctgtttcatacgactgccagggtttaccatccaccagttcaggtacgaacggacgaatatgctgacagttatcgaggatcagtttgcgggcattaatgccatttaccacacaatccatccacatattacgaccgctgacaccttcatgcattttggcgttgatattcagtgcggcaaacagcggatagaacgggctggtggaggcgtgcatcataaaggcgttgttcatgcgtttgtgcggtacataacgctgttgccctttgatgtggctgtcttttttatgaatttgtgaagtctgagaaaaaccagcctgttgtttatgcacagattgcgtaaccagaatacccggatcgttctcattaagatccagcaacagcggcgaacagtccgccatcatcggaataaactgttcatagccgacccatgctgagtcaaacaggatgtagtcacacagatgaccaattttatccaccacttggcgggcgttataaatcgtaccgtcgtaggtgcctaactgaatcacagcgaggcggaaaggacgagcctcttttgcccgctgcggtgcgacttccgcgatcagctcacgcaggtaactttcttcaaaacagtgcgcatcaatgccaccgataaagccatacgggttacgtgccgtttccagataaaccggtgttgcaccagcctgtagcaacgctccgtggtggttagatttgtggttattgcgatcaaacagcaccagatcacccggtgttagcagggcgtttaaaaccactttgttagaagatgaagtgccatttaaaacgaagtaggttttatcggcattaaacacttttgccgcatgttgctgtgcaatgcatggcgcgccttcgtgaatcagcagatcgcccatcgctacgtcggcgttgcacaagtcggcacggaacagcgcctcaccaaagtattccacaaactgattccccgccggatggcgacggaaaaattcgccgccctgatgaccagggcaatcaaacgcgctgttaccttgattgacataatcgaccagtgcgcggaagaaaggtgggcgcagttgagtttcataatggctggcagcggtttctaactggcgaccataaaattctcgtcgcgattcgcaattctcaaagacacccgaaatacggggcaaatactctgcgggtacacgttcttgattttcagtagcaataaataccgggatgccataacccgtggcatcgatttcatcgagttttccgcatgtaacatcgttgagcgataaaactattgccgccacatcgatattacgactttcattaatgtagatacattctcgctgcgtggtaaaacagtccgggcaagaatcactaaccgcaatttttaattttgacatttttcatctctttattttaggtaatagcaggtcctcaatttctcgaatgagaaatcgatcgtgccggaaaaaagcaaagttaccccgctgataaataaatcaggtagattgcttttttcagaatgcagaaacccttaccagtcaggtggctgataatacaagggttaacagagaatgagcactgcggaatacaggcatatgcctgtaatacagagagtcaggaagacctgtacgctgaagtgcccttagtcggtagactaacgggcattgaagaagtgaaagtcgaagctattgcgatgagcaaacttcataatatgagttgtccgccttatatggggcatagtgcggctgttattttccatttaatttacctttcctgatgtgaatgaaggtgaagatattctatccaggaaatacggttgaactgtgaaggtgatcaataaaaaatgatcaatcttaatttatttaatgatgagctttttactcagtaatataaaatattgaattgttatttttgtgtgttgtttaagataaaaagccgtatttattattacggctttaattaataaaaggcaggctgtattaaaattaatattcaaagcataaaccgatagccaataccggtttcagtaatgaaatggcgtgggcgggcgggatcctgttccagtttttgtcgcagatgtcccatataaatacgcaaatagtgactgtgttcgaccgcgtttggcccccacacctggttaaggagctggcgctgggtgagtacttttccggcattgttgagcagcaccgccagcaggcggaactcaattggtgtgagatgcacctcttcctcaccccggtgaatcacgcgggcggctaaatcgacggtaacatcggaaaattttaccagcggatcgggcgcggtggtggcagagtggcggcgtaatgcgacgcgcagacgggcctgcaattcgccaatgccaaacggcttactcagataatcatccgctccggcatccagcgcggcgattttgtcgctctcttcgctgcgtgcggaaagcacaatcaccggcaccgcgctccactggcgcaggtcgcggataaactcaatcccatcaccatcgggcaggccgagatcgagaataatcaaatctggcttacgggttgccgcttccagcaagccgcgttgcagcgtttcggcctcaaagacgcgcatcccgtcgccctccagcgccgtgcgcagaaagcgacgaatagcctgttcatcttcaacaatcagaacgtttgtcacatatcctcatgaaattcttcaagttcaggggcagtttgctggggaagtgtaacacgaaaacaggcaccaccttccggtcggttgaacgcggtaatagtgcccccgtgtacatccactatcgcccgacaaattgccagtccaagccctacccccggtactgccgactctttattcccgcgagcaaacttatcaaatatcgtctgctcctggcctggcggaagaccggggccgttatcccagacatccagttgtagattttcgccctcaacgtgggcatcgataccaatttcggcctgcgcacccgcatatttcaccgcgttctccagcagattaatcagcacccgttcaaagagtggcccgtcaacgtggattaaggtcagcggttctggcagagaaagattgatgggcgacgataaacccggttccagcatttgcagcgcgctgccgactacttcttccagcgttaaccactctttcttcaaattaaagccgccggactgaattcgcgccatatccagtagattattcaccagtcgggtagtgttcagcacatgctgacggatctcgctggcctggcgggcgtggggtgatccttcgcttgccagatcgagcgttaagatttctgcctgaccaaacagcaccgtaagcggcgtgcgtaaatcatgcgaaagcgccgccagcagggcgttgcggatctgttcacgttcgcttgccatccgcgcctgttcttcgctggcggttagcgtcagccgctcaagggcattggcgactaacagcgtaaacgtctccagcaggcgctgctgttccgggatcatcaactggcgcagattccccggctccaccaccaccagcccgtaggttttctcgccgctttttagcggcaaaatctggtacggtacaccgggtaacgtgtcggtgcccgcgcccgcaggcaggcctttatcaaaactccactgcgcgatggcatcgtcccacggcgtcattccttgcggatgtgttaacggctgcaatttaccgttgtcatcgggcaacaacacctgactgcgggcatgaaacgtggaggcaataaattgttcgctggtggcagcgatatcctgcggactgcggcccaccgccagagctttcgacatttcatataagtgccgtgtgcgttgctcgcggtaacgggctacccgcgcctgataacgcacgccagcagtaaggttcccgatcaccagcccgacggttaacatcaccgcgaaggtcagcagatattgcacatcagagacggcgagcgtgccgcgtggggcgataaaaaagagatcgaaactcactacattaatgacggtggcaaccactgaaggccagcgtccataaaatagcgccaccaccaccacgccaagcagatacagcatcaccaggttggcggcatcaaacgccatcagccactgcatggcaattaaggtgataacggcgcataacgcggcggcaaccacgcatccctgaatttgtacacgccacttgtctttaaaagagcggttatccggcgcgttgttaatcgtgcgggcgggtggttcatcaagcgcgaccagcacctgatcgagatcgggggcgatgcgcgccagtcggtcagcaaacgtttcccgacgccaccagcggcgcgaggccgggcgaccgagaataatcttgccgagattatgttcacgggcataacgcactaccgctttctcttccgctggatcagaaagtgttgccgtctccgcgcccagttcctgcgccagacgtaaggcgctgagaattgcccgacgttttttttccggtaagcggtgcagggcaggggtttcaacatacaccgcgtgccagacgctacccagccgtgacgccagccgcgccgctgcgcggaccagtttttcgctgccggtgttatggccgatgcataaaaggatcgcgtcgcgcgtgtgccacactttctcttcgccaggatgcccccgccaggcgcgcatttgctcatcaacgcgatcggcagtacggcgcagtgccagttcgcgcagggcgatcagattacctttgcggaaaaaatgttcaatggcgcgctccgcctgcccggcaatatagactttgccttctttcagccgctggcgcagatcgtccgggggcaagtccaccagcaccacgtcgtcggcggcatcgaaaaaaggatcgggcacggtttcccgtacctgaattccggtgacgccgctgaccacatcattcagactttccagatgctgaacgttgacggtagtgaaaacatcaatgccagcttccagcagttcttcgatatcctgccagcgtttgggatgacgggaacctggcgcattactgtgcgccagttcgtccattaagatcagcgccgggcggcgggcgagggcggcatcgagatcaaactcgctgatatgccgcccacggtacgcctggcgttttaacggcagaacagccagcccttccagcatggcggcggtatcttttcgcccgtgggtttctaccacgccaaccacaatatccagcccttgcgcccgcagtcgctgggcttctgccagcatcgcccaggtcttcccgacgcctgcacaggcaccgaagaaaactttcagcttcccccgatgcggcgcggcagtttgttccagcagacgatcggggtcgggacgtaagggttcgttattcatcaagtttatccagcgccagattgagttcaacaatgttgacaaccggctggccgatatatttcaccagcggttgttggctgtattttgcgatcagttgcgtgagctgttcaacgctgagattacgcgctttcgccacgcgtgggatttgccaggccgccgcttgcggggtgatattattgtccagcccgcttgccgatgccgtcaccagttcaaccggaacgctcgcgctggcatccgggttagcggcccgtaatgcagcaacgcgtgcggctattagtttatccagctcagggttactgaccgccagattgctcccgccagaagcctgtggattatagggcatttctgccgttgccgacgggcgaccatgaaaatagccgttgccggtaaaattctgcccgattaatgccgaaccgcgcaccgtatcaccttcacgaatcaacgaaccattggcctgccagggaaaccaccattgccccagtacggtggtcagcagcgggtaaacgccgccagtaatcaataacagaaagataaatgttgataatgccggacgtaatccactcatggtaaacctcacaccagaccgcaaacggtcagcagtaaatcaatgactttgataccgataaacggcaccagcagcccacccagaccgtaaatccataagttacggcgcaacatggcagaagcggtaagcggtttataactcacgccttttaacgccaggggaatcaaaaagacgataatcaaggcgttgaaaatcaccgcactgaggattgcggagtcgggcgaatgcaggcacatgatgttcagcgcatttaactgcggatacgttgccgcgaatgccgccggaataatggcgaagtatttcgccacatcgttggcaatgctgaaggtggtcagcgagccacgggtcatcagcatctgtttgccaatgtgcaccacctcgatcaacttggtcgggttagagtcgagatcgaccatattgcccgcctctttcgccgcctgggtgccggagttcatcgccaccgcgacatctgcctgcgccagcgccggagcatcgttggtgccgtcgccggtcatcgctaccaaacgaccttccgcctgatactgacggatcaatgccagcttggcctccggtgtcgcttcggcgagaaaatcatcgacacccgcttccgcagcaatcgcggcggcagtcagacggttatcgccggtaatcatcaccgttttaatgcccattttgcgcagctgggcgaagcgctctttaataccgcctttgacgatatctttcagcgcaataacgcccagcacacgagaaccttccaccaccaccagcggcgtggctccctgacgcgcaacctgatcgactttttgatcaacatcggtagggaagtgaccaccgttagcctcaacatggcgacgaatggcatcgacagaacctttacggatcatgcggttgtcgatgttgatcccgctcatccggctttgcgcagtaaacggtacaaaggtggcatggagcgactgcacatcgcgctcgcgcaggttaaaacgctgcttggcgaggatcacaatactgcggccttccggcgtttcatcagccagcgaagccagttgtgcggcgtcagccagcgttttttcatccacgccctgcgcggggataaactccgacgcctgacggttaccgagtgtgatggtgccggttttatccagtagcagaacgtcaacgtcacctgccgcttcaactgcacgtccgctggtggcaatcacattcgcgcctagcatccggctcatcccggcgacgccgatcgctgacaacaggccgccaatagtggttgggatcagacagaccagcagcgccaccagtaccgttacgctgactgcattaccgccccacgcggaaaacggccacagcgtggcggttgccagtaaaaagacgatagtcagggcaatcagcagaatggtcagggcaatttcgttcggcgttttgcgtcgctgtgcgccttccaccatcgcgatcatccgatccagaaatgtctcgccggggttaacgctacactcaatcaccagccagtcagaaagaatacgcgtgccgccggtgacggaggcaaaatcgccgccggattcacggatcaccggtgccgattccccggtgatggcgctttcatcgaccgatgcacccccttcaataacttcaccatcgcaggggataatatcgccagcttctaccagtacgatatcgcctttacgaagttggtcggcaggaactttgtccgccgcagcgccatatttcggctcacgcagcttgcgggcaaaggcagtttttttcacccctttcagactgttggcctgcgctttactgcggccttctgccagcgcctcggcgaaattagcgaacagtacggtgatccacagccaaccgctaatggccgcgctaaacagcgcattgccgggcatcgcaccgcttgccatcgcgatgctaatacaggtggtcagcagactgccgatccagacgataaacatcaccggattgcgccattgcgcctgcgggtttaattttttcaccgcttctttcagcgcctgaacgacaagtgttggttcgaatagcgccagttgtttacgactcatattcagtgctcactcaatatcatcaggagagatattccgccaccggaccaagcgccagggcagggataaaggtcagtgcgccaaccagcaacacggtgccgattaacaggccaacaaacagcgggccgtgcgttggcagcgtgccggagctggcggcttggctctttttactcaccagcgaaccggcaattgccatcaccgggataatcaccccgaagcgaccgacaaacatgcagaacgccagtaaacagttccagaacggagagttggcgcttaatccggcaaaggcgctgccgttgttgttagcggcggatgacacggcgtacagcacttcgctaaaaccatgcgggccagggttgagcatggcgctacgtccggcgtcggtcatcatcgccaacgccgcgcccatcagcaccagcgtcggggtaaccagaattgccagtgcagtcagtttcatctcgcgtacgtcgatttttttacccagatattccggtgtacgaccaatcatcagcccggcaataaacaccgccagcaggacaaacagcatcatgccgtaaagaccagaaccgacaccgccgaacaccacttcaccaatttgcatcagccacatcggcaccatgccaccgagagcggtaaacgaatcatgcatcgcaatcaccgcgccacaggaagccgccgtcgtcacgaccgcaaacaggctactgaccagcacgccgaaacggctctctttaccttccatattgatgctgctgtccgtgcccagtgccagcagatgaggattaccctgaacttctgcccacatcaccacgcctacgcagatgacaaaaatcactgacatcgcccacagcaacatgcgcccctggcggcgatcgcccatcacttcaccaaaggcaaagcacagcgccgttgggatcaagaagatcgccagcatctgcacgaagttggtcagtgcggttgggttttcaaacggatgcgacgagttggcattaaagaagccaccgccgttagtaccgagcatcttgatcgcttcctgagaagctacaggccccatgggtaacagctgttgcgctccttcaacggtattcacagcctgataaggcagaaagttttgcagcgcaccttgttgaataaaaaacagtgcaatcaacaacgccacagggactagcacccataacgtgatgcgtagcagatcgacccaggcattcccgagcgtgctcatgctctggcgggtaaacgcacggatgagggcaaaaatcaccgcaatcccgctggcggcagaaagaaagttttgcaccgttaagcccgccatctggctgaaatagctcaacgtggtttcaccgctataagattgccagttggtattggtgacaaagctgacggcggtattcagcgccagatcccacgacagccctggcaactgctgtggattaagcggcagatagtgctgaccgagcaacataaaaaacagcaccgccagccccagcatgttcaggccgagaatggcacaaagatattgcttccagttcatctcacggtcagagacgccaagtgcgcgaaaaagtacgcgctcaacgcccgttgtaccgggaagaggaatgtcattaatcagccgcgccagcccgctgcctaaaggacgcgccagcaccattaacaccagtaaaaacgtggcgatcagtaagaacccttgcgcagccatcagaacgcctccgcattgatcagggcataaaccagataacccagtaataaaaacaccagcaatacgccggttatcacgcctgcactcacagtgcacctccagtggcctaaaagtgataccggaagggtagaattctggctgcaaagatttcgcaaaaatctgcgggcggggtgtaaaaaaagtataaaaatggcaaaagccatgatttaactaatgtttagtattaatttaacttttgtgtaacttaattacaggatgaatgtaaataaaccatcaataagcaaaaataagtggtcggatgagtagtaaaattacacaaaaggcggtactattttcatcagataaacaaattcatttttccggtgccattcaccgggtagatacaaaagggggagaaaagtatggaactctacagagaatatcctgcatggcttatctttttacgccgtacttatgcggttgcagcgggcgttctggcgctgcctttcatgcttttctggaaagaccgcgcccgcttttacagctacctgcatcgcgtctggtcgaaaaccagcgataaaccggtgtggatggatcaggccgaaaaggcaactggtgatttttattgattgctgagttttgaatacattgaaaaccgccagcggaaacgctggcggttttttgtatcaggaagatgttcagaggaatatttagacatcgttataccaatcgaaacatatattcatgaaatatatataaatattttcctaattgttcttatctgacagatatctcacttaaggctttcttataaatctgtagggtttcgcctgtcagcagacaaataacccgataaaacaaggatgagcagatgagcggaaaaccggcggcgcgtcagggcgacatgacgcagtatggcggtagcattgtccagggttcagccggggtacgcatcggtgcccccaccggcgtggcctgttcggtgtgccccggcggggtgacgtccggccatccggtcaatccgctgctcggtgcaaaggtccttcccggtgaaaccgacatcgccctgcccggcccgctgccgttcattctctcccgcacctacagcagttaccggacaaaaacgcccgcgccggtggggagcctcggccccggctggaaaatgcctgcggatatccgcttacagctgcgcgataacacactgatactcagtgataacggcggcagaagcctgtattttgagcacctgtttcccggtgaggacggttacagccgcagcgagtcactgtggctggtgcgcggcggcgtggcgaaactggatgaaggtcaccggctggccgcactctggcaggcgctgccggaagaactccgcttaagtccgcatcgttatctggcgacaaacagtccgcaggggccgtggtggctgctcggctggtgtgagcgggtgccggaagcggatgaggtgctgcctgcgccgctgccgccgtaccgggtactgaccgggctggtggaccgcttcgggcgcacacagacgttccaccgcgaagccgccggtgaattcagcggcgaaatcaccggcgtgacggatggtgccgggcgtcacttccggctggtactgaccacgcaggcgcagcgggcagaagaagcccggcagcaggccatttccggcgggacggaaccgtccgcttttcctgataccctgccgggttacaccgaatatggccgggacaacggcatccgtctgtctgccgtgtggctgacgcacgacccggaatacccggagaatttacctgccgcgccgctggtgcgctatggctggacgccccgcggcgaactggcggcggtgtatgaccgcagcaatacacaggtgcgcagctttacttacgatgataaataccggggccggatggtggcgcaccgtcacacgggccgaccggaaatctgttaccgttacgacagcgacgggcgggtgacagaacagctaaacccggcaggcttaagttacacgtatcagtatgagaaggaccgcatcaccatcaccgacagcctgaaccgccgtgaagtcctgcacacgcagggtgaaggcgggctgaagcgggtggtgaaaaaggaacacgcggacggcagcgtcacgcagagtcagtttgacgcggtgggcaggctcagggcacagacggatgccgcaggcaggacaacagaatacagtccggatgtggtgacgggcctcatcacgcgcatcaccacgccggatggcagggcatcggcgttttactataaccaccacagccagttaacgtcagccaccgggcctgacgggctggaaatacgccgggaatatgatgaatggggccgtctgattcaggaaactgcccctgacggcgatatcacccgctaccgttatgataatccacacagtgacttaccctgcgcaacggaagatgccaccggcagccggaaaaccatgacgtggagccgttacggtcagttgctgagcttcactgactgttccggttatgtaacccgctatgaccatgaccgttttggtcaggtgacggcggtgcaccgcgaggaagggctgagtcagtaccgcgcatacgacagccgtggacagttaattgccgtgaaagacacgcagggccatgaaacgcggtatgaatacaacgccgccggtgacctgaccaccgtcattgccccggacggcagcagaaacgggacacagtacgatgcgtggggaaaagccatctgtaccacgcagggcggtctgacgcgcagtatggaatacgatgctgccggacgggtcatccgcctgaccagtgaaaacggcagccacaccaccttccgttacgatgtactcgaccggctgatacaggaaaccggctttgacggccgcacacagcgttatcaccacgacctgaccggcaaacttatccgcagcgaggatgaggggctggtcacccactggcactatgacgaagcagaccgcctcacgcaccgcaccgtgaatggcgaaaccgcagagcggtggcagtatgacgaacgcggctggctgacagacatcagccatatcagcgaagggcaccgggtgacggtgcactatggttatgacagtaaaggccgcctcgccagtgaacacctgacggtgcatcatccgcagacgaatgaactgctctggcagcatgagaccagacatgcgtacaacgcacagggactggcgaaccgctgtataccggacagcctgcccgccgtggaatggctgacctacggcagcggctggctgtcaggcatgaaactcggcgacacaccgctggtggagtacacccgcgaccgcctgcaccgggaaacgctgcgcagcttcggccgttatgaactcaccaccgcttatacccctgccgggcagttacagagccagcacctgaacagcctgctgtctgaccgcgattacacctggaacgacaacggcgaactcatccgcatcagcagcccgcgccagacccggagttacagctacagcaccaccggcaggctgaccggcgttcacaccaccgcagcgaatctggatatccgcatcccgtataccacagacccggcaggtaaccgcctgcccgacccggagctgcacccggacagcgccctcagcatgtggccggataaccgtatcgcccgtgacgcgcactatctttaccggtatgaccgtcacggcaggctgacagagaaaaccgacctcatcccggaaggggttatccgcacggatgatgagcgcacccaccggtaccattacgacagtcagcaccggctggtgcactacacgcggacacaatatgcagagccgctggtcgaaagtcgctatctttacgacccgctgggccgcagggtggcaaaacgggtatggcggcgtgaacgggacctgacgggctggatgtcgctgtcacggaaaccgcaagtgacctggtacggctgggacggcgaccgcctgaccacgatacagaacgacagaacccgcatccagacgatttatcagccggggagcttcacgccactcatcagggttgaaaccgccaccggtgagctggcgaaaacgcagcgccgcagcctggcggatacccttcagcagtccggtggcgaagacggtggcagtgtggtgttcccgccggtgctggtgcagatgctcgaccggctggaaagtgaaatcctggctgaccgggtgagtgaggaaagccgccgctggctggcatcgtgcggcctgacggtggcgcagatgcaaagccagatggacccggtatacacgccggcgcgaaaaattcacctgtaccactgcgaccatcgcggcctgccgctggcccttatcagcacggaagggacaacagcgtggtacgcagaatacgatgaatggggtaacctgctgaatgaagagaacccgcatcagctgcagcagcttatccgcctgccggggcagcagtatgatgaggagtccggcctgtattacaaccgccaccgctattatgacccgctgcaggggcgatatatcactcaggatccgattgggctgaaagggggatggaatttttatcagtatccgttgaatccgatctcaaatatagatccattaggattagaaacactaaaatgcattaagccactgcattcaatgggcggaactggtgaaagaagcggtccagatatatgggggaatccgttctatcatcaatatctttgtgtcccagatggtaaaggggactatacttgtggtggccaagaccaacggggagaatcaaaaggagatggtctatgggggccaggtaaagcaagtaatgatacaaaagaagctgctggccgttgtgacctcgttgaaaccgataatagttgtgtggagaactgtttaaaagggaagtttaaagaggtaaggccgcgttattctgtattgcctgatatattcacacctataaatttagggctatttaaaaactgccaagactggtctaatgattctttagaaacatgtaagatgaagtgctccggaaataacattggacgttttattagatttgtattcaccggagtgatgtaatgaaatatattatttttttattcagagctatatggctggctttatcgcttttaatactattcttttccatgcatagactttcactattagactccactcgtgatgtgagcgagttaattagtctcatgtcttatggaatgatggtaatatgttttccaacaggcatagtattctttattgctctaatatttatagggactgtatcagacattattggcgtaaggattgatagtaagtatattatggcgataataatatggctttattttctgtcaggagggtatattcaatggtttgtattaagtaagcgcattataaacaaataaattaagttaattgctcttattattatatgtaacctgggcattgatatcccgtatgccacagacccggcaggtaaccgcctgcccgacccggagctgcacccggacagcaccctcagcatgtggccggataaccgtatcgcccgtgacgcgcactatctttaccggtatgaccgtcacggcaggctgacggagaaaaccgacctcatcccggaaggggttatccgcacggatgatgagcgcacccaccggtaccattacgacagtcagcaccggctggtgcactacacgcggacacaatatgcagagccgctggtcgaaagccgctatctttacgacccgctgggccgcagggtggcaaaacgggtgtggcgacgtgaacgggacctgacgggctggatgtcgctgtcacggaaaccgcaagtgacctggtacggctgggacggcgaccgcctgaccacgatacagaacgacagaacccgcatccagacgatttatcagccggggagcttcacgccactcatcagggttgaaaccgccaccggtgagctggcgaaaacgcagcgccgcagcctggcggatacccttcagcagtccggcggcgaagacggtggcagtgtggtgttcccgccggtgctggtgcagatgctcgaccggctggaaagtgaaatcctggctgaccgggtgagtgaggaaagccgccgctggctggcatcgtgcggcctgacggtggagcagatgcaaaaccagatggacccggtgtacacgccggcgcgaaaaatccacctgtaccactgcgaccatcgcggcctgccgctggcgcttgtcagcacggaaggggcaacagaatggtgcgcagaatacgatgaatggggcaacctgctgaatgaagagaacccgcatcagctgcagcagcttatccgcctgccggggcagcagtatgatgaggagtccggcctgtattacaaccgccaccgctattatgacccgctgcaggggaggtatatcactcaggatccgattgggctgaaggggggatggaatttttatcagtatccgctgaatccggttcagtatatagattcaatgggactggcatcaaaatatggacacttaaataatggcggatatggagcgagacccaacaaaccgcctacgcccgatccaagtaaattgccggacatagcgaaacaattaagactgccatatcctattgaccaggccagtagtgcgcctaatgttttcaaaacattcttcagagcattaagcccttacgactacacactgtattgcaggaagtgggtaaaaccaaatctgacttgtacgccacaggatgattcccagtatccagggatggatacaaagacagcaagtgattacctgccacagacaaattggccaacaactcaattaccaccaggatatacttgtgcagaaccctatttattcccagacattaataaacccgatgggccagcaacagcagggatagatgatttgggtgaaattttagctaagatgaaacagagaacatcgagaggaataagaaaatgaaaagagttttgttctttttgctgatgatatttgttagttttggtgttatagctgattgcgaaatacaagctaaagatcatgattgttttactattttcgctaagggtactattttttccgcgtttcctgtcttaaataataaagccatgtggagatggtatcagaatgaggacatcggtgagtattattggcaaacagaactgggtacatgtaaaaataataaattcacaccaagcggggcgagactcttaattcgcgtcgggtcactacgccttaatgaaaatcatgccatcaaaggaacgttgcaggagttgataaatacagcagaaaaaacggcgtttctcggcgatcggtttagaagttatataagagcgggtatctatcaaaaaaagagcagtgatccagttcagttgttggcagtccttgataattcaatcatggtaaaatattttaaagatgagaaaccaacttatgctcgaatgacagcacatctcccgaacaaaaatgagtcttacgaatgtttaataaagatacagcatgaactaattcgtagtgaagagaaataaaatctcttcctgagaaaacaaattaatcattgtgaaaaattatataactcatggaataggtgtttattttgcgttccatttgcagggaaagatcacgtaacgctacttttttgtactaaataattcgaattttaagttcaacaattgagatactacttattgtctaaagctgtttttcatagcttatacatgatcaaatactccttacataaataaggtgaacaaatggaacttaaaaaattgatggaacatatttctattacacccgattacagacaagcctggaaagtggtgcataaattgtcagatattctactgttgactatttgtgccgttatttctggtgcagaaggttgggaagatatagaggatttcggggaaacacatctcgattttttgaagcaatatggtgattttgaaaatggtattcctgttcacgataccattgccagagttgtatcccagggaaagatcacgtaacgctacttttttgtactaaataattcgcattttatgtttaaaaattgagatattccttattacctaaagctgtttttcatagcttatacatgatcaaatactccttacataaataaggtgaacaaatggaacttaaaaaattgatggaacatatttctattattcccgattacagataagcctggaaagtagagcataaattgtcaggcatcctactattgactatttttgccgttatttctggtgcagaaagttgggaagatatagaggatttcggggaaacacatctcgatttcttgaagcaatatggtgattttgaaaatggtattcctgttcacgatactattgccagagttgtatcctgtatcagtcctgcaaaatttcacgagtgctttattaactggatgcgtgattgccattcatcaaatgataaagacgtcattgcaattgatggaaaaacgctccggcactcttatgacaagagtcgccgcaggggagcgattcatgtcattagtgcgttctcaacaatgcacagtctggtcatcgggcagatcaagacggataagaaatccaatgagatcacagctatccctgaacttcttaacatgctggatattaaaggaaaaatcatcacaactgatgcgatgggttgccagaaagatattgcagagaagatacaaaaacagggaggtgattatttattcgctgtaaaaggaaaccaggggcggcttaataaagcctttgaggaaaaatttccgctgaaagaattaaataatccagagcatgacagttacgcaatgagtgaaaagagtcacggcagagaagaaatccgtcttcatattgtttgcgatgtccctgatgaacttattgatttcacgtttgaatggaaaggactgaagaaattatgcgtggcagtctcctttcggtcaataatagcagaacaaaagaaagagccagaaatgacggtcagatattatatcagttctgctgatttaaccgcagaaaagttcgccacagcaatccgaaaccactggcacgtggagaataagctgcactggcgtctggacgtggtaatgaatgaagacgactgcaaaataagaagaggaaacgccgcagaattattttcagggatacggcacatcgctattaatattttaacgaatgataaggtattcaaggcagggttaagacgtaagatgcgaaaagcagccatggatagaaactatctcgcgtcagtccttgcggggagcgggctttcgtaatctttccctgctttttgtactaaataattcgcattttatgtttaaaaattgagatattccttattacctgaagctgttttttattgcttatacatgatcaaatacttcttacataattaaggagaacaaaatggaacttaaaaaattgatggaacatatttctattatccccgattacagacaagcctggaaagtggaacataaattatcggatattctactgttgactatttgtgccgttatttctggtgcagaaggctgggaagatatagaggattttggggaaacacatcccgattttttgaagcaatatggtgattttgaaaatggtattcctgttcacgataccattgccagagttgtatcctgtatctgtcctgcgaaatttcatgagagctttattaactggatgcttgactaccattcttcagatgataaagacgtcatcgcaattgatggaaaaatacaccggcattcttatgacaagagtcgccgtaagggagcgattcatgtcattagtgcgttctcaacaatgcacagtctggtcatcggacagatcaagacggataagaaatccaatgagatcacagctatccctgaacttcttaacatgctggatattaaaggaaaaatcatcaaaaccgatgcgatgggttgccagaaagatattgcagagaagatacaaaaacagggaggtgattatttattcgctgtaaaaggaaaccaggggcggctaaataaagccttcgaggaaaaatttccgctgaaagaattaaataatcccaagcatgacagttacgcaattagtgaaaagagtcacggcagagaagaaacccgtcttcatattgtttgcgatgtccctgatgagcttattgatttcacgtttgaatagaaagggcagctatggttagaaactacctgacgtcagtccttgcggggagcaggctttcgtaaatttgtcctgctacaacaggattaacttcacaaatatcatttctcaacgtctacacttactcctgtaaaccgctcaggagcagtaatgaatctacaacgatttgatgacagcaccctaatccgtatctttgcccttcatgagttacatcgactgaaagaacatggcttaacgcgcggggcgcttctcgattatcacagccgctataaactcgtctttctggcgcattctcagccggagtaccgcaaacttggcccgttcgtggctgatattcaccagtggcaaaatctggatgactattacaaccagtaccgccaacgcgtagttgttttgctttctcaccccgccaacccgcgcgatcacaccaatgttttgatgcacgttcagggttattttcgcccgcatattgattccacagaacgccagcagctggctgcgcttatcgacagttatcgccgtggcgagcaaccacttcttgcgccgctgatgcgtatcaaacactatatggcgctttatcctgacgcctggctttcagggcagcgttatttcgaactttggccgcgtgtgattaacttgcgccattcaggagttttatgactacccatctggtctggtttcgccaggatttacgtctgcacgataatctcgcactggctgccgcctgccgcaattcgtctgcacgcgtgctggcgttgtatatcgctacaccacgccagtgggcgacgcataacatgtcgccgcgtcaggctgaacttatcaatgctcaactgaatgggctacaaatagcgcttgcggaaaaaggtattcctttattgttccgtgaagtggatgactttgtcgccagtgtcgaaatagttaaacaggtgtgcgcggaaaacagcgttacccacctgttttataactatcagtatgaagtgaatgagcgggcgcgggatgtggaagttgaaagagcgctgcgtaacgtggtgtgtgaaggatttgatgacagcgtgatcctgccgcctggcgcggtgatgaccggtaatcacgagatgtacaaagtctttacgccttttaagaatgcctggctgaaacggctgcgggaagggatgccggagtgcgtcgctgcgccaaaagttcgtagtagcggatcgatagagccctcgccatccattacgctgaattatcctcgtcagtctttcgatactgcgcattttccggtggaagaaaaagcggcgattgcgcaattacgccagttttgccagaacggtgccggagaatatgagcaacaacgagattttccggcagtggaaggcaccagccgtttgtcggccagcctggcaacgggcgggttatcgcctcgccagtgcttgcatcgcttgttggctgaacagccgcaggcgctggacggtggggccggtagtgtctggcttaatgagctgatctggcgcgagttttaccgtcacctgataacgtatcacccctcgttgtgtaaacatcgtccatttattgcctggacggatcgtgtacagtggcagagcaatcccgcacatttacaggcctggcaggaaggcaaaacgggatacccgattgttgatgccgctatgcgtcagcttaacagcactggctggatgcataacaggctacggatgattacagccagttttctggtgaaagatttattgatcgactggcgcgaaggcgagcgatatttcatgtcgcagctgattgatggtgatttggcagccaataacggtggctggcagtgggccgcttcaaccggaaccgatgcagcgccgtattttcgtattttcaacccgacaacccagggcgagaaatttgatcatgagggcgagtttatccgccagtggctaccggaactgcgcgatgtgccagggaaagtggtgcatgagccgtggaagtgggcgcagaaagcaggtgtgacgctggattatccgcaaccgatagtcgagcacaaagaagcgagagtacaaacgttggcagcgtatgaggcggcgcggaaggggaaataacagacgcgtcaggcaatcgagcccagatgccggatgcggcgtgaacgccttatccagcctacaaatttgtgcaaattcaataaattgcaggaaatacgtaggcctgataagacgcgtcaagcgtcgcatcaggcatcggtgctggcctattaagactccagcgccagcgcgcggtttctgaatttcagcgcctgatacagccaaatcatcagtaccagtcctacacacgccagtgcgccccaggtaatttgatcaaatacttcaatatatgcattgatggagtagttgatcgccccggaagcatcaaacgaagcctgcgatgtctgatcggcaatcacgcccgccagatagttcgcgatcgcgccagaaagcagcatgtagatgccggttaatacgccggtcacaccggggatttcaatgcgcgtaatttgcgacatggcaaccgggtcgataaacagttccgcaaagcccatcaccgccaggcctaataccatcagtggcagagaagagtgaccatacattgcggaccagcgggcgcttaaggtcagaatgcagaatccggcgctcatcaggccaaggccaagagcaaatttcccccagatgcgcacggtacgattacccgcgacactctcttttaccacccacgccaggaacacaccgcacagcataactgcgaaggcattaatcgactggaacatcgcggtcggaacggtataaccaaacatatcgcggttaacgaagcggtcgatataaaggctaatcgagctaccgccctgttgtgcgaaggcccagaacaacatactgaagaaggtgagcgtcacaatcagccccagctccttccgctgtttctggttttctgctttgcgataaatttttgccagtacacccaggccaataatagtcgcgacaattaaggcgtataccgaccactctttccagaacagtatggtaatcagtgcaggcgttgccaccagcagaaccagcagccatccccagttcggcaggagaaagtttgtcgcacgcagtacttttttgttaacgccgcgggtatgagtgaaatgacgattgccacataagaaaatgaccagacccgcgatcatgccaaccgccgccaggccaaagcccatcgcccagctgtactcttcctgggcgtaaccacaggcgataggtgcgataatagaccccacgttacccgccgcatacatcagcgagaaaccgccatcacgacgcggatcggttggctcatacagctcgccgagcagacagcttacgttagatttaaacaggccatagccgcagacgataatcgccagggacagatagaggaatgacggatggatctcactggcacccagcaccacatgaccgatcgccatcaacaacgcccccagcatcaccgccatgcgattgccgagaactttatccgccaaaaagccaccgaggattggcgtgacatacaccagcgaacagtaggcgctaaataactcgtaggcgtgagtatcgttgtattttagttgattggtgagatagagaatcagcagggcacgcatgccgtaaaagctaaaatattcccagatttgcagcgcaacgacatagtaaatagcgcgcggctgtgatgcgtgtttattcataataattccacaattgacggcaacgtcacgtaatagttgcgcggcgtgcttgtgtttccttaaagttaaaactttgatacagatctgattatttatgcaatatgctgtctgattgcataaatatacattagctgaagcgtgatgatataaacaatttgcgtcttttggcgtcgggtttgtttcttaatatgtcaaaagattggctatcgacgaactggcgaggtaacgctatgttaacggtgtagctatcagaatacggaaggcgcgaagatgaaaaacaccgaactggaacaactgattaacgaaaaactgaacagcgcggcgattagtgattacgcgccgaatggtttgcaggtggaaggcaaagagacggtgcaaaaaattgttaccggtgtcaccgccagccaggctttgctcgatgaggcagtgcgtctgggcgcggatgcggtcattgtgcatcatggctacttctggaaaggagagtctccggtcattcgcggaatgaagcgtaaccgtttaaaaacgttgctggcgaatgatatcaacctgtatggctggcatttgccgcttgacgcacatcctgagctgggcaataacgcacagctggcggcgttactggggatcacggtcatgggcgaaattgagccgttggtgccgtggggcgaactgaccatgcctgtgccgggactggagctggcttcctggattgaagcgcgtctgggacgtaagccgttatggtgtggcgataccggacctgaggtggtccagcgcgtcgcctggtgcacgggcggcgggcaaagttttatcgatagcgccgcgcgttttggcgtggatgcttttattactggcgaagtttctgaacagaccattcattcagcccgcgagcagggattgcatttttatgctgcaggtcaccatgccactgaacgtggtggtattcgcgcattgagcgagtggctgaatgaaaataccgatcttgatgtgacctttattgatattcctaatcctgcataacgaataatcagagggatcgaaagtgcaacgagcgcgttgttatctgataggtgaaacggcggtagtgctggaactggaaccgccggtgacgctggctagccagaaacggatctggcgactggcgcagcgtctggtggatatgccgaatgtggttgaagccattcccggcatgaacaatatcacggtgattttgcgtaatcctgagtcgctggcgctggatgccatagagcgtttgcaacgctggtgggaggagagcgaggcgctggagccggagtctcgctttattgaaattccggtggtttacggtggtgcaggcggaccggatttggcggtggtcgcggcgcattgcgggttgagcgaaaaacaggttgttgaattgcactcctccgtggaatacgtggtctggtttttaggttttcaaccgggcttcccgtatctcgggagtttgccggaacaactacacacgccacggcgcgctgaaccgcgcttactcgttccggcaggttctgtcgggatcggcgggccgcagactggtgtttatccgctggcaacgccgggtggctggcagttgattggtcatacctcactcagcctgtttgatccggcgcgtgacgaacccatcttattacgtccgggagacagcgtgcgctttgtaccgcagaaggagggagtatgctgaagattattcgtgcgggcatgtataccactgtgcaggatggcggtcgtcacggttttcgccagtcgggtatcagccactgcggcgcactggatatgcccgcgttacgcattgctaacctactggtgggtaatgacgccaatgcccccgcgctggagatcacgctcggtcagttaactgttgagttcgaaactgatgggtggtttgctctgacgggtgccggttgcgaagcgcggctggatgataatgccgtctggaccggctggcgattgccgatgaaagcaggccagcgtttaacgcttaaacgcccgcagcacgggatgcgcagttatctggcggtcgcgggtggtattgatgttccgccggtaatgggctcatgcagcaccgatctcaaagtggggattggcgggctggaaggccgtttactgaaggatggtgaccgactcccgattggcaaatcgaagcgtgattctatggaagcgcagggcgttaaacagctgctgtggggcaaccgcattcgcgccttgccggggccggaatatcatgagttcgatcgcgcctcgcaggatgcattctggcgttcgccctggcagcttagctcgcaaagtaaccgcatgggctatcgcttacaggggcaaattttaaaacgcaccaccgatcgcgaactgttatctcacggtttgttaccgggcgtggtgcaggtgccacataacgggcagccgattgtgttgatgaacgacgcacagaccaccggtggttacccgcgtattgcctgtatcattgaggctgatatgtaccatctggcgcaaattccgctcggtcagccgattcattttgtccagtgttcactggaagaggcactaaaagcacggcaagatcagcaacgttattttgaacaattagcgtggcggctgcacaatgaaaattgacctgaacgccgatctgggcgaaggctgcgccagcgacgcagagctattaacgctggtttcctctgccaatattgcctgtggatttcatgcaggcgatgcgcaaatcatgcaggcttgcgtgcgtgaagcaataaaaaatggtgtcgcgattggcgctcacccgagttttcccgacagggaaaattttggtcgcagcgccatgcagctgccgccagaaaccgtttacgcccagacgctgtatcaaattggcgcgctggcaacgattgcccgtgcgcaaggcggcgtaatgcgtcatgtcaaaccgcacggcatgttgtacaaccaggcggcgaaagaagcacaactggcagacgccatcgccagagcggtatacgcttgcgatccagcattgattctcgtcgggctggcgggaagcgagctgattcgtgcaggcaagcaatatggtctgacaacgcgcgaggaagtgtttgccgatcgcggttatcaggctgacggctcgctggtgccgcgaagccagtcaggcgcgttgattgaaaacgaagaacaggcgctggcgcaaacgctggagatggtgcaacacggcagagtcaaaagtatcaccggcgaatgggcaacggtcgcggcgcaaacggtctgcctgcatggcgacggcgagcacgcactggcgttcgcccgccgactacgctctgcatttgccgaaaaggggattgttgtcgcagcataaccccgattaataaagaatgaaaaaaggatatcaccatgcctgaaggcccggagatccgccgtgcagcggataacctggaggcggcgatcaaaggcaaaccactaactgatgtctggtttgccttcccgcagttaaaaccttatcaatcacaacttatcggtcaacacgttacccatgtggaaacgcgtggtaaggcgttgttaactcatttttccaacgacttaacgctctacagccataatcagctttacggcgtctggcgcgtggttgataccggcgaagagccgcagaccacgcgagtattgcgggtaaaactgcaaacggctgacaaaaccattctgctttatagcgcctcggatattgagatgttgaccccggaacaactgaccacgcatccgtttttacaacgcgttggtcccgatgtgctggatccgaatctgacgccggaggtggtgaaagaacgattattgtcgccgcgctttcgtaaccgtcagtttgctggattactgctcgatcaggcgtttctggctgggcttggcaattatttgcgggtggagatcctctggcaggttgggttgactggaaatcataaagcgaaagatctcaatgcggcgcaactggatgcactcgcacacgcgttactggagattcctcgattttcctacgctacgcgggggcaggtggatgagaataagcatcatggggcgctgtttcgctttaaggtttttcatcgagatggcgaaccgtgcgaacgttgtggcagcatcattgagaaaaccacgctgtcatctcgcccgttttactggtgccctggctgccagcactaggccgaccgcttcggcgcataggttgaaataaaccgcgcaatggcaggccctgtcagcaaaatactgaacaggcgtagggtttgcatcgccataatgagcgccatatcggcattgctccctgcggcgatgaccgccacggtatcaagcccgccggggctggtggcgaggtaggcagtcataaaatcaatgtgcataaaccgggtcagcccccacgccatacccgcacaaatagccagcagagcaaaaatcgacagcaggatttgcggtagcgggcgtagtgcccgcagtaagatttgtttatcgaaaccaagaccaatccgccagccaattgccatatacgccatcgccagcagccattccggtagttcgatggtgatgagctgaccagactggagcactgcgcccgccagcatcgggatgagcatcgtgccggaaggaagacgcagcaggcatcccactgtaccggcaacgaccgcgagcaaaatagtaagcaggagattaatgctcactggcgggaaccagacgatatgctggttaaccgcttcagcgttatcgcccagcatcatgcgggtgaccagaacagcggcccccgcgacgaacagcactcgcagatattgcataaacgccaccaggcgaatatctgcgccgtaatcttgcgccatagcgaccattgccgccgcgccgccaggagaggagccccaggcaccggtatttccaggcaatgagctatagcgcaccaataaccaacccacaatggcgctggaaagcagcgttaccagtaaaattgcaagcacgatcggccagttgacggccagggtggtgagaatcgaaccagtgaggttttgcgcaatcatgcagccaagaatggcctgggcggcgagaaaagcagagcggggaagttgcagagtaattccgcgcatactaaagatgatcccggcgatcatcggcccaagtaatagcgccgccgggagatgtaccgcgaggaaaccaatagaaaggagaagtgatagcacacataacattccccactgcaaaactggcatccttcgctccctcattattttctctttggtgtatcgatacagcataaagaaagctgggccaggaaaaaataacagcaatcaaggaaaaggggaaaatcagcaattttctgaaagagatgccctttccggcggcaaagggcatcatggtaaatcagttatagttaatcttaaaaagcaccactgtatcgaaggggccagcctcgatgggggtgcctggaatggacgaaagttcagccgtataggttttttcgtagaccaacatgtcactggtgaaatcggcgtattcagcatatttattgaaggtataaggcgaggcgttttcatccagtaaacgtagcttcagaccattaccaatcaacaatgctttatcttcttcaaccaacgtttcttcggtataaaaggaggaactgactttaaatccgtcggtgcattgatcgttttggctcttggtcgttttaatactgaacgttttcgacattgtgtggcgacgtatatccagcaaattaaatttaccaaaatcaatcacctgtgtttccggtgaaatggaaaaattgacgctgcaatccagcacgcgaatgttttccagaccagtaatatgatatttcaggttttgggcagtagggtcttcgttaacgctaccggcaccgtcaaattgcacgacgatatagtcgctaagcgtactttgataatcatgcggcggcatttctcgtattttgacgtataaccgcatgcgagcgagaaaggtacgcgacatatgaatattagcgggatcgcccgagcaaattttgttctgccatcccatcgcgatgatctgctcaggggtataaatatcaatgttcttactgtcgatacactggttagtgtcgatgcgactttttcccagactggcatcgtaatcgacaccgttgtatgtcacgccgagttgataataacgatcctgcacccccggataggggtttacccaggcgtagacatgctcgctttcaaagttgccgttggtattgttgtcacaatagacgggaattttaatatcgtcagattcccagatcttatcaccgggtttggcattgcctggtacagcaaacggttgaatcgcttctgatttttctactgcgccaccagatgtaccaaaatagcagttcagcgccattgcagacttcaacggcagaaataacaggcagatgacgagcaacaatcccttgccagcactcatttcgcctccactgcttgtaaacggcattgtccgctgcagttgagcgtcgtcatgcgtaatgcgccgtaatcatccatgtaaccgagataaaactggctgccgctataacttccggtgtttgtgttgaccgtactaaaaggtgcaaccatcacggttttgaagcctgggagaacgcctttttcatttctccccagataggcaatggtcagataatacgcggtaggatttttcagtgtcagttggttgccctgctggctgacctgtaactgcagttcgaccttttctcctgctttcttgcgtaatgcagccggtcgccagaacaatttaatacgactttgaatagcgacctgaagtatcgcatggtcgctgcttttatccggagcgggaggaatttcgcgcatattgtagaaaaatagcgtttcgcgatcgccaggtaattgtgtggttgaggcttgtttcacaacccgcacctgcgatgtcgctttcggttccagacgttgaatagggggcaaagcgaccagaagagcatcgcttttctcccctttttcattttctatccaggaataagcaagataaggcagtttgtcactttggttttcgatacgcaggctggtggctttgtcattggcgttaaacacaatgcgtgtgcgatcgggttgcaccgcagcattgcaacccaagctgatggttaacaacattaagggtaatcctttaataaatgtcattctcttttccttaattaatgacaaggtaaaatcaggcgtttggtcgtgtcttccagacgttctggcagatgaataatgcagctttgctcaccccagaccacggtaaacagttgattttcagcgacaccgcttaaccaggcatgtccttcctcgccaaccatacccacgctaatgccgctgtcatcctggcggatatccgcaccgaggggagggaactgaccgctggcgttgcgtatgatgacgttaacgtctttaccggaacgggaagccagtgatttgtaacctatcgcgccttcaatccatgtttccttgatgacgttttctgcaactgttacgccgtcgggtaagtcattcatgttcaccgccacggtggaaggctggtaactggaaatcaacggcaccaccgcaatgccaaaatggttggtgtagtcgagattgccctgaaccggaatatctgccacgccatcggtgctgaccatcaggcgtggttcattggtggagctgcggcgatgaaatgctgcaccatattgggttgcggtgaaagaaccgctccagctgctgctgacggaactgtaatcactggcggcataggtaccagaaatatcccactcacccgctgaactcaggtgctgatagttaccgctcacctgggctccattgtccggacgatcggattgcagtccggcagacatgccccagctattacgttcatccagcgtatcgttccacgacatgcggtgtatggtgctgtggctactgttttgcatgtcatagccaacccgaccaccgttaccgaaggggagcgaaatcgacagataaatctggttgtcgcgatctttatcttcgtagtgggtcgtattgaatgacgtcgaaatcgagatatctctccagtcaccaatatcaacattaaaacctgctgtgatgttggcggtcgtggaggcgtctgcattccaccaggtttgatgtagcaggttggcgtaaagattgaggtttagtggggtaatcggttggcccacggataagctgatcgtctgtttttcgtcctgcgcatcgctgtcgttgtatttgtgatccagatagttggcgtagctgtgaaaatgacgatctgagaagcgataagcggcgagcgaaatcgtgctgttggtggcatccacttgtttgctgtaattaaaacggtagcttaagccccgctcgtcctgctgagtatcaaaatggctactggcccaggtgacatcaaaggacagtgcgccaagccacagcatattttgcccgatacccattgcggcagaatggtagtcatcatcagaaatcagcaggccgccgtacagcgaggtgtttgagagcatcccccaggaaacttcattgctaaaaaaggtttcattttcagtttgatgtgacatggaaggccgtggctgacccgcggccaatttatagcgaacctgtccctggcgagtcaggaagggcgtcgatgctgccgaaacctggaaattgttcacccgaccatcttcttccgtcactttgacatccagcgtgccctgaacagactgattgaggtcatcaataataaacgggcctggcgggacttttttctggtaaatgacgcggcctgattgactgatcgtcaccgtggcattggtctgtgcaataccgctaatttgtggggcgtagccacgcagctcccacggtaacattcgatcgtcactcgccagtgccgcgccggtataagaaaaaccatcgaaaatattggaactgaaatcggtttcgccgagggttaacttagagcctaattgcggtaatggacgaaaaagataggtgcgcgatattccgcctgactggtcatggttatcttcgctatcggtcttattaagctggtaatcactgcgtaagcgccatgccccggcgttaattccggcggtaccgtaggcattcaggttagtgctgctgctgccgtcctgtgggcggtagctgctggcaaacaagttgtaatccatcaggacaccggcaacaccttctttccatgtagaggggggagcccagttttctgagtgccacgccagccaggcttgcggaatactaatattcagttgctgattggcttgatcgaaattgaagagcatttcaggtcgggaactgaaatcaatacaccgatctatctgtggcaaggactgacggatatctggttttaaaccaaatttatcgaccagtgaatcattgatgcatggaatggttttgtcaccctttttttgccagttaattttttgcccattactgattttgttgttattcaccgcaacgctaacaaaatattcaccgggagcaatgactcctttttcctttaataatgaaatatcaatgcggtcgcgcattgatttatcgagaacattcagattgaattcgaccgccattgcgcaaggcatcgccatgaccaggcaggatacaaaagagagtcgataaatattcacggtgtccatacctgataaatattttatgaaaggcggcgatgatgccgccaaaataatacttatttataatccagcacgtaggttgcgttagcggttacttcacctgccgtgacatcgactgcattatcaatttgttccatccaggcgaaaaagttcagcgtctgttctgatgagcttgcatccaggtcaagatctggcgcggctgaacctaatacgatgttaccgtcatttttgtccatcagtcgtacaccgaccccagttgcttcgcctgcactggtgttgctcaacaaaggcgtagcaccagttgtcttagccgtgctatcgaaggttacgccaactttggataccggcattccgctaccgttgtcagaagcaggcagatcacagttgatcaagcgaatgtcgacggccactttattgctatgatgctcccggtttatatgggttgtcgtgacttgtccaagatctatgtttttatcaatatcttctggatgaatttcacaaggtgcttcaataacctcccccttaaagtgaatttcgccagaaccttcatcagcagcataaacaggtgcagtgaacagcagagatacggccagtgcggccaatgttttttgtcctttaaacataacagagtcctttaaggatatagaataggggtatagctacgccagaatatcgtatttgattattgctagtttttagttttgcttaaaaatattgttagttttattaaatgcaaaactaaattattggtatcatgaatttgttgtatgatgaataaaatataggggggtatagatagacgtcattttcatagggttataaatgcgactaccatgaagtttttaattgaaagtattgggttgctgataatttgagctgttctattctttttaaatatctatataggtctgttaatggattttatttttacaattttttgtgtttaggcatataaaaatcaacccgccatatgaacggcgggttaaaatatttacaacttagcaatcaaccattaacgcttgatatcgcttttaaagtcgcgtttttcatatcctgtatacagctgacgcggacgggcaatcttcataccgtcactgtgcatttcgctccagtgggcgatccagccaacggtacgtgccattgcgaaaatgacggtgaacatggaagacggaatacccatcgctttcaggatgataccagagtagaaatcgacgttcgggtacagtttcttctcgataaagtacgggtcgttcagcgcgatgttttccagctccatagccacttccagcaggtcatccttcgtgcccagctctttcagcacttcatggcaggtttcacgcattacggtggcgcgcgggtcgtaatttttgtacacgcggtgaccgaagcccatcaggcggaaagaatcatttttgtctttcgcacgacgaacaaattccggaatgtgtttaacggagctgatttcttccagcattttcagcgccgcttcgttagcaccgccgtgcgcaggtccccacagtgaagcaatacctgctgcgatacaggcaaacgggttcgcacccgaagagccagcggtacgcacggtggaggtagaggcgttctgttcatggtcagcgtgcaggatcagaatacggtccatagcacgttccagaatcggattaacttcatacggttcgcacggcgtggagaacatcatattcaggaagttaccggcgtaggagagatcgttgcgcgggtaaacaaatggctgaccaatggaatacttgtaacacatcgcggccatggtcggcattttcgacagcaggcggaacgcggcaatttcacggtgacgaggattgttaacatccagcgagtcgtgatagaacgccgccagcgcgccggtaataccacacatgactgccattggatgcgagtcgcgacggaaagcatggaacagacgggtaatctgctcgtggatcatggtatgacgggtcaccgtagttttaaattcgtcatactgttcctgagtcggtttttcaccattcagcaggatgtaacaaacttccaggtagttagaatcggtcgccagctgatcgatcgggaaaccgcggtgcagcaaaataccttcatcaccatcaataaaagtaattttagattcgcaggatgcggttgaagtgaagcctgggtcaaaggtgaacacaccttttgaaccgagagtacggatatcaataacatcttgacccagcgtgcctttcagcacatccagttcaacagctgtatccccgttgagggtgagttttgcttttgtatcagccatttaaggtctccttagcgccttattgcgtaagactgccggaacttaaatttgccttcgcacatcaacctggctttacccgttttttatttggctcgccgctctgtgaaagaggggaaaacctgggtacagagctctgggcgcttgcaggtaaaggatccattgatgacgaataaatggcgaatcaagtacttagcaatccgaattattaaacttgtctaccactaataactgtcccgaatgaattggtcaatacttccacactgttacataagttaatcttaggtgaaataccgacttcataacttttacgcattatatgcttttcctggtaatgtttgtaacaactttgttgaatgattgtcaaattagatgattaaaaattaaataaatgttgttatcgtgacctggatcactgttcaggataaaacccgacaaactatatgtaggttaattgtaatgattttgtgaacagcctatactgccgccaggtctccggaacaccctgcaatcccgagccacccagcgttgtaacgtgtcgttttcgcatctggaagcagtgttttgcatgacgcgcagttatagaaaggacgctgtctgacccgcaagcagaccggaggaaggaaatcccgacgtctccaggtaacagaaagttaacctctgtgcccgtagtccccagggaataataagaacagcatgtgggcgttattcatgataagaaatgtgaaaaaacaaagacctgttaatctggacctacagaccatccggttccccatcacggcgatagcgtccattctccatcgcgtttccggtgtgatcacctttgttgcagtgggcatcctgctgtggcttctgggtaccagcctctcttcccctgaaggtttcgagcaagcttccgcgattatgggcagcttcttcgtcaaatttatcatgtggggcatccttaccgctctggcgtatcacgtcgtcgtaggtattcgccacatgatgatggattttggctatctggaagaaacattcgaagcgggtaaacgctccgccaaaatctcctttgttattactgtcgtgctttcacttctcgcaggagtcctcgtatggtaagcaacgcctccgcattaggacgcaatggcgtacatgatttcatcctcgttcgcgctaccgctatcgtcctgacgctctacatcatttatatggtcggttttttcgctaccagtggcgagctgacatatgaagtctggatcggtttcttcgcctctgcgttcaccaaagtgttcaccctgctggcgctgttttctatcttgatccatgcctggatcggcatgtggcaggtgttgaccgactacgttaaaccgctggctttgcgcctgatgctgcaactggtgattgtcgttgcactggtggtttacgtgatttatggattcgttgtggtgtggggtgtgtgatgaaattgccagtcagagaatttgatgcagttgtgattggtgccggtggcgcaggtatgcgcgcggcgctgcaaatttcccagagcggccagacctgtgcgctgctctctaaagtcttcccgacccgttcccataccgtttctgcgcaaggcggcattaccgttgcgctgggtaatacccatgaagataactgggaatggcatatgtacgacaccgtgaaagggtcggactatatcggtgaccaggacgcgattgaatatatgtgtaaaaccgggccggaagcgattctggaactcgaacacatgggcctgccgttctcgcgtctcgatgatggtcgtatctatcaacgtccgtttggcggtcagtcgaaaaacttcggcggcgagcaggcggcacgcactgcggcagcagctgaccgtaccggtcacgcactgttgcacacgctttatcagcagaacctgaaaaaccacaccaccattttctccgagtggtatgcgctggatctggtgaaaaaccaggatggcgcggtggtgggttgtaccgcactgtgcatcgaaaccggtgaagtggtttatttcaaagcccgcgctaccgtgctggcgactggcggagcagggcgtatttatcagtccaccaccaacgcccacattaacaccggcgacggtgtcggcatggctatccgtgccggcgtaccggtgcaggatatggaaatgtggcagttccacccgaccggcattgccggtgcgggcgtactggtcaccgaaggttgccgtggtgaaggcggttatctgctgaacaaacatggcgaacgttttatggagcgttatgcgccgaacgccaaagacctggcgggccgtgacgtggttgcgcgttccatcatgatcgaaatccgtgaaggtcgcggctgtgatggtccgtgggggccacacgcgaaactgaaactcgatcacctgggtaaagaagttctcgaatcccgtctgccgggtatcctggagctttcccgtaccttcgctcacgtcgatccggtgaaagagccgattccggttatcccaacctgtcactacatgatgggcggtattccgaccaaagttaccggtcaggcactgactgtgaatgagaaaggcgaagatgtggttgttccgggactgtttgccgttggtgaaatcgcttgtgtatcggtacacggcgctaaccgtctgggcggcaactcgctgctggacctggtggtctttggtcgcgcggcaggtctgcatctgcaagagtctatcgccgagcagggcgcactgcgcgatgccagcgagtctgatgttgaagcgtctctggatcgcctgaaccgctggaacaataatcgtaacggtgaagatccggtggcgatccgtaaagcgctgcaagaatgtatgcagcataacttctcggtcttccgtgaaggtgatgcgatggcgaaagggcttgagcagttgaaagtgatccgcgagcgtctgaaaaatgcccgtctggatgacacttccagcgagttcaacacccagcgcgttgagtgcctggaactggataacctgatggaaacggcgtatgcaacggctgtttctgccaacttccgtaccgaaagccgtggcgcgcatagccgcttcgacttcccggatcgtgatgatgaaaactggctgtgccactccctgtatctgccagagtcggaatccatgacgcgccgaagcgtcaacatggaaccgaaactgcgcccggcattcccgccgaagattcgtacttactaatgcggagacaggaaaatgagactcgagttttcaatttatcgctataacccggatgttgatgatgctccgcgtatgcaggattacaccctggaagcggatgaaggtcgcgacatgatgctgctggatgcgcttatccagctaaaagagaaagatcccagcctgtcgttccgccgctcctgccgtgaaggtgtgtgcggttccgacggtctgaacatgaacggcaagaatggtctggcctgtattaccccgatttcggcactcaaccagccgggcaagaagattgtgattcgcccgctgccaggtttaccggtgatccgcgatttggtggtagacatgggacaattctatgcgcaatatgagaaaattaagccttacctgttgaataatggacaaaatccgccagctcgcgagcatttacagatgccagagcagcgcgaaaaactcgacgggctgtatgaatgtattctctgcgcatgttgttcaacctcttgtccgtctttctggtggaatcccgataagtttatcggcccggcaggcttgttagcggcatatcgtttcctgattgatagccgtgataccgagactgacagccgcctcgacggtttgagtgatgcattcagcgtattccgctgtcacagcatcatgaactgcgtcagtgtatgtccgaaggggctgaacccgacgcgcgccatcggccatatcaagtcgatgttgttgcaacgtaatgcgtaaaccgtaggcctgataagacgcgcaagcgtcgcatcaggcaaccagtgccggatgcggcgtgaacgccttatccggcctacaagtcattacccgtaggcctgataagcgcagcgcatcaggcgtaacaaagaaatgcaggaaatctttaaaaactgcccctgacactaagacagtttttaaaggttccttcgcgagccactacgtagacaagagctcgcaagtgaaccccggcacgcacatcactgtgcgtggtagtatccacggcgaagtaagcataaaaaagatgcttaagggatcacgatgcagaacagcgctttgaaagcctggttggactcttcttacctctctggcgcaaaccagagctggatagaacagctctatgaagacttcttaaccgatcctgactcggttgacgctaactggcgttcgacgttccagcagttacctggtacgggagtcaaaccggatcaattccactctcaaacgcgtgaatatttccgccgcctggcgaaagacgcttcacgttactcttcaacgatctccgaccctgacaccaatgtgaagcaggttaaagtcctgcagctcattaacgcataccgcttccgtggtcaccagcatgcgaatctcgatccgctgggactgtggcagcaagataaagtggccgatctggatccgtctttccacgatctgaccgaagcagacttccaggagaccttcaacgtcggttcatttgccagcggcaaagaaaccatgaaactcggcgagctgctggaagccctcaagcaaacctactgcggcccgattggtgccgagtatatgcacattaccagcaccgaagaaaaacgctggatccaacagcgtatcgagtctggtcgcgcgactttcaatagcgaagagaaaaaacgcttcttaagcgaactgaccgccgctgaaggtcttgaacgttacctcggcgcaaaattccctggcgcaaaacgcttctcgctggaaggcggtgacgcgttaatcccgatgcttaaagagatgatccgccacgctggcaacagcggcacccgcgaagtggttctcgggatggcgcaccgtggtcgtctgaacgtgctggtgaacgtgctgggtaaaaaaccgcaagacttgttcgacgagttcgccggtaaacataaagaacacctcggcacgggtgacgtgaaataccacatgggcttctcgtctgacttccagaccgatggcggcctggtgcacctggcgctggcgtttaacccgtctcaccttgagattgtaagcccggtagttatcggttctgttcgtgcccgtctggacagacttgatgagccgagcagcaacaaagtgctgccaatcaccatccacggtgacgccgcagtgaccgggcagggcgtggttcaggaaaccctgaacatgtcgaaagcgcgtggttatgaagttggcggtacggtacgtatcgttatcaacaaccaggttggtttcaccacctctaatccgctggatgcccgttctacgccgtactgtactgatatcggtaagatggttcaggccccgattttccacgttaacgcggacgatccggaagccgttgcctttgtgacccgtctggcgctcgatttccgtaacacctttaaacgtgatgtcttcatcgacctggtgtgctaccgccgtcacggccacaacgaagccgacgagccgagcgcaacccagccgctgatgtatcagaaaatcaaaaaacatccgacaccgcgcaaaatctacgctgacaagctggagcaggaaaaagtggcgacgctggaagatgccaccgagatggttaacctgtaccgcgatgcgctggatgctggcgattgcgtagtggcagagtggcgtccgatgaacatgcactctttcacctggtcgccgtacctcaaccacgaatgggacgaagagtacccgaacaaagttgagatgaagcgcctgcaggagctggcgaaacgcatcagcacggtgccggaagcagttgaaatgcagtctcgcgttgccaagatttatggcgatcgccaggcgatggctgccggtgagaaactgttcgactggggcggtgcggaaaacctcgcttacgccacgctggttgatgaaggcattccggttcgcctgtcgggtgaagactccggtcgcggtaccttcttccaccgccacgcggtgatccacaaccagtctaacggttccacttacacgccgctgcaacatatccataacgggcagggcgcgttccgtgtctgggactccgtactgtctgaagaagcagtgctggcgtttgaatatggttatgccaccgcagaaccacgcactctgaccatctgggaagcgcagttcggtgacttcgccaacggtgcgcaggtggttatcgaccagttcatctcctctggcgaacagaaatggggccggatgtgtggtctggtgatgttgctgccgcacggttacgaagggcaggggccggagcactcctccgcgcgtctggaacgttatctgcaactttgtgctgagcaaaacatgcaggtttgcgtaccgtctaccccggcacaggtttaccacatgctgcgtcgtcaggcgctgcgcgggatgcgtcgtccgctggtcgtgatgtcgccgaaatccctgctgcgtcatccgctggcggtttccagcctcgaagaactggcgaacggcaccttcctgccagccatcggtgaaatcgacgagcttgatccgaagggcgtgaagcgcgtagtgatgtgttctggtaaggtttattacgacctgctggaacagcgtcgtaagaacaatcaacacgatgtcgccattgtgcgtatcgagcaactctacccgttcccgcataaagcgatgcaggaagtgttgcagcagtttgctcacgtcaaggattttgtctggtgccaggaagagccgctcaaccagggcgcatggtactgcagccagcatcatttccgtgaagtgattccgtttggggcttctctgcgttatgcaggccgcccggcctccgcctctccggcggtagggtatatgtccgttcaccagaaacagcaacaagatctggttaatgacgcgctgaacgtcgaataaataaaggatacacaatgagtagcgtagatattctggtccctgacctgcctgaatccgtagccgatgccaccgtcgcaacctggcataaaaaacccggcgacgcagtcgtacgtgatgaagtgctggtagaaatcgaaactgacaaagtggtactggaagtaccggcatcagcagacggcattctggatgcggttctggaagatgaaggtacaacggtaacgtctcgtcagatccttggtcgcctgcgtgaaggcaacagcgccggtaaagaaaccagcgccaaatctgaagagaaagcgtccactccggcgcaacgccagcaggcgtctctggaagagcaaaacaacgatgcgttaagcccggcgatccgtcgcctgctggctgaacacaatctcgacgccagcgccattaaaggcaccggtgtgggtggtcgtctgactcgtgaagatgtggaaaaacatctggcgaaagccccggcgaaagagtctgctccggcagcggctgctccggcggcgcaaccggctctggctgcacgtagtgaaaaacgtgtcccgatgactcgcctgcgtaagcgtgtggcagagcgtctgctggaagcgaaaaactccaccgccatgctgaccacgttcaacgaagtcaacatgaagccgattatggatctgcgtaagcagtacggtgaagcgtttgaaaaacgccacggcatccgtctgggctttatgtccttctacgtgaaagcggtggttgaagccctgaaacgttacccggaagtgaacgcttctatcgacggcgatgacgtggtttaccacaactatttcgacgtcagcatggcggtttctacgccgcgcggcctggtgacgccggttctgcgtgatgtcgataccctcggcatggcagacatcgagaagaaaatcaaagagctggcagtcaaaggccgtgacggcaagctgaccgttgaagatctgaccggtggtaacttcaccatcaccaacggtggtgtgttcggttccctgatgtctacgccgatcatcaacccgccgcagagcgcaattctgggtatgcacgctatcaaagatcgtccgatggcggtgaatggtcaggttgagatcctgccgatgatgtacctggcgctgtcctacgatcaccgtctgatcgatggtcgcgaatccgtgggcttcctggtaacgatcaaagagttgctggaagatccgacgcgtctgctgctggacgtgtagtagtttaagtttcacctgcactgtagaccggataaggcattatcgccttctccggcaattgaagcctgatgcgacgctgacgcgtcttatcaggcctacgggaccaccaatgtaggtcggataaggcgcaagcgccgcatccgacaagcgatgcctgatgtgacgtttaacgtgtcttatcaggcctacgggtgaccgacaatgcccggaagcgatacgaaatattcggtctacggtttaaaagataacgattactgaaggatggacagaacacatgaacttacatgaatatcaggcaaaacaactttttgcccgctatggcttaccagcaccggtgggttatgcctgtactactccgcgcgaagcagaagaagccgcttcaaaaatcggtgccggtccgtgggtagtgaaatgtcaggttcacgctggtggccgcggtaaagcgggcggtgtgaaagttgtaaacagcaaagaagacatccgtgcttttgcagaaaactggctgggcaagcgtctggtaacgtatcaaacagatgccaatggccaaccggttaaccagattctggttgaagcagcgaccgatatcgctaaagagctgtatctcggtgccgttgttgaccgtagttcccgtcgtgtggtctttatggcctccaccgaaggcggcgtggaaatcgaaaaagtggcggaagaaactccgcacctgatccataaagttgcgcttgatccgctgactggcccgatgccgtatcagggacgcgagctggcgttcaaactgggtctggaaggtaaactggttcagcagttcaccaaaatcttcatgggcctggcgaccattttcctggagcgcgacctggcgttgatcgaaatcaacccgctggtcatcaccaaacagggcgatctgatttgcctcgacggcaaactgggcgctgacggcaacgcactgttccgccagcctgatctgcgcgaaatgcgtgaccagtcgcaggaagatccgcgtgaagcacaggctgcacagtgggaactgaactacgttgcgctggacggtaacatcggttgtatggttaacggcgcaggtctggcgatgggtacgatggacatcgttaaactgcacggcggcgaaccggctaacttccttgacgttggcggcggcgcaaccaaagaacgtgtaaccgaagcgttcaaaatcatcctctctgacgacaaagtgaaagccgttctggttaacatcttcggcggtatcgttcgttgcgacctgatcgctgacggtatcatcggcgcggtagcagaagtgggtgttaacgtaccggtcgtggtacgtctggaaggtaacaacgccgaactcggcgcgaagaaactggctgacagcggcctgaatattattgcagcaaaaggtctgacggatgcagctcagcaggttgttgccgcagtggaggggaaataatgtccattttaatcgataaaaacaccaaggttatctgccagggctttaccggtagccaggggactttccactcagaacaggccattgcatacggcactaaaatggttggcggcgtaaccccaggtaaaggcggcaccacccacctcggcctgccggtgttcaacaccgtgcgtgaagccgttgctgccactggcgctaccgcttctgttatctacgtaccagcaccgttctgcaaagactccattctggaagccatcgacgcaggcatcaaactgattatcaccatcactgaaggcatcccgacgctggatatgctgaccgtgaaagtgaagctggatgaagcaggcgttcgtatgatcggcccgaactgcccaggcgttatcactccgggtgaatgcaaaatcggtatccagcctggtcacattcacaaaccgggtaaagtgggtatcgtttcccgttccggtacactgacctatgaagcggttaaacagaccacggattacggtttcggtcagtcgacctgtgtcggtatcggcggtgacccgatcccgggctctaactttatcgacattctcgaaatgttcgaaaaagatccgcagaccgaagcgatcgtgatgatcggtgagatcggcggtagcgctgaagaagaagcagctgcgtacatcaaagagcacgttaccaagccagttgtgggttacatcgctggtgtgactgcgccgaaaggcaaacgtatgggccacgcgggtgccatcattgccggtgggaaagggactgcggatgagaaattcgctgctctggaagccgcaggcgtgaaaaccgttcgcagcctggcggatatcggtgaagcactgaaaactgttctgaaataaatatctgtaataagaaatagccctcgccgcttccctctacaggaatggcgaagggctgtcggtttcgacatggttggccatcgtatgatggccttttttgtgcttatcgcgatgattttcgctgcgctatcagggtaaatttatagtcatcggtattaaaagcgttgcggctatattcaaacacccgaccatcaactaaatatccacgcgatactttttcaagaatcggctttgtctggctgatattaagcagacggctcatctcttcggttggcatcagaggaatgatttcctgttcgctacgatcgataaccattttcttcacttcttcgataaagtgatatttcgaattttccatgacctgccaggtgagatccgggaacaacgcaagcggcatccaggtttcttccagcgccattggcttttgcttgcgatagcgcacgcgcttcacatgccacacacgatcctgcggggtgatttgtagctgttgctgaagaaaatcgtcagccggaatcacttcgaatatcagaacttcactgtgtgtatcgacgtgacggtccgacagtttttcatcaaaactggttaactgaaaaatatcgtaattgacccgctcttctttgacgtaagtcccgctgccctgaatgctttcgaggatctgctgctcgactagctggcgcaaagcctgacgcaccgtaacccggctgacgccaaactctgtttgtagcgctgattcagtgggtaacgcatcgccaggtttaagctcgccacgcgcaatttgttcacgaatgcgatcggcaatctgccggtataagggcttgtgtcccatttttagtatctcattaatacgaatttaaccattatgcccgataaattcatcctgtaaataatacaaatacaatacaaataatttcaatcaagtgaaattgatcacataatggtattgttttatcgggcacactggcgcgactataaaaacgatcaagtgaggatcatgatgaatctgacgactctgacccaccgcgatgcgttgtgtctgaatgcgcgctttaccagccgtgaagaggccatccacgcgttgactcaacgtcttgctgctctggggaaaatttccagtactgagcaatttctggaagaagtgtatcgccgtgaaagccttggcccgaccgccttaggtgaagggttggctgtgccgcatggcaaaactgctgcggtaaaagaagcggcgtttgcggtcgccacactcagcgagccgcttcagtgggaaggcgttgatggcccggaagcagttgatttagtggtgctgctggcgattccccccaatgaagcgggtactacgcatatgcaactgctgacagcgctgaccacgcgccttgcggatgatgagattcgggcgcgtatacagtcggcgacgacgcctgatgagttgctctcggcgctggatgacaagggaggcacgcaaccttctgcctctttttccaacgcgccaactatcgtctgcgtaacggcctgtccggcgggtattgctcacacctatatggctgcggaatatctggaaaaagccggacgcaaactcggcgtaaatgtttacgttgaaaaacaaggcgctaacggcattgaagggcgtttaacggcggatcaactcaatagtgcaaccgcctgtatttttgcggctgaagtcgccatcaaggagagtgagcgttttaatggcattcccgcgctttcagtgcctgttgccgagccgattcgccatgcagaagcgttgatccaacaagcgcttaccctcaagcgtagcgatgagacgcgtaccgtacagcaagatacgcaaccggtgaaaagtgtcaaaacggagctgaaacaggcactgttgagcggaatctcttttgccgtaccgttgattgtcgcggggggcacggtgctggcggtcgcggtattactgtcgcaaatcttcgggctacaagatctgtttaatgaagaaaactcctggctgtggatgtaccgcaagctgggcggcgggctgctcggaattttgatggtaccggtgctcgcggcctataccgcctattctctggcagataaaccggcgttagcgccaggctttgcggctggacttgccgccaacatgatcggctccgggtttctcggcgcggtcgttggcggattgatagccggttacttgatgcgctgggtgaaaaatcacttgcgtcttagcagtaaattcaatggattcctgactttttatctctacccggtgctcggtacgttgggagcgggcagtctgatgctgtttgtggtgggggaacctgtcgcctggatcaataactcgcttaccgcctggctgaacggtctgtcaggaagtaacgcgctgttgctgggtgccattctcggttttatgtgttcctttgaccttggagggccagtgaataaagccgcttatgcattctgcctgggcgcaatggcgaacggcgtttacggcccgtatgccattttcgcctccgtcaaaatggtttcggcatttaccgtaaccgcttccacgatgctcgcaccgcgcctgtttaaagagtttgaaattgagaccgggaaatccacctggctgttagggctggcaggtattaccgaaggggcgatcccgatggcgattgaagatccgctgcgggttattggttcgtttgtgctgggctctatggtaacgggcgctattgtcggtgcgatgaatatcggcctttcgacacccggtgccggcattttctcgctctttttacttcatgataatggcgcgggcggtgttatggcggcaattggctggtttggcgcggcattggtgggggctgcaatctcgactgcaattctcctgatgtggcggcgtcacgcggttaagcatggcaactatctgactgatggcgtaatgccataaacaaaaaggaaacgacgatgaaagcagtatctcgcgttcacatcaccccgcatatgcactgggatcgagagtggtatttcaccaccgaagagtcacgtattctgctggtcaataatatggaagagatcctgtgccgactggaacaggacaacgaatacaaatattacgtactcgacgggcaaacggcgatcctcgaagattatttcgcggtgaaaccggaaaacaaagaccgtgtgaagaaacaggtagaagccggcaagttgattatcggcccctggtatacccagaccgataccacgattgtttctgcggaatccatcgtccgtaatctgatgtacggaatgcgtgactgcctcgcgtttggcgagccgatgaaaataggttatttaccagattcctttggcatgtccgggcaactgccgcatatctacaatggatttggcattacccgcaccatgttctggcgcggatgttcggagcgccacggtactgataaaaccgagtttttgtggcaaagcagtgacggtagcgaagtgacggcgcaggtgctgccgctgggctacgccatcggtaagtacttacctgccgacgaaaacggattacgtaaacgcctcgacagttattttgacgtgctggaaaaagcgtctgtaaccaaagagattttgctgccgaatgggcatgaccagatgccattgcagcaaaatatcttcgaagtgatggataagctacgtgagatctaccctcaacgtaagtttgtgatgagccgctttgaagaggtatttgagaagatcgaagcgcagcgagataatctggcaaccctgaaaggggaatttattgatggcaaatatatgcgcgtgcatcgcaccatcggttctacgcgtatggatatcaaaattgcccacgcgcgtattgaaaataagattgttaatctgctggaaccgctggcaacactggcctggacgttgggttttgaataccaccacggcttgctggagaaaatgtggaaagagatcttaaaaaatcatgcccacgacagtatcggctgctgctgtagtgacaaagttcatcgcgaaatcgtcgcccgcttcgaactggctgaagacatggcggataatctgattcgtttctacatgcgcaaaattgccgacaacatgccgcagagcgacgccgacaaactcgtcctgtttaacctgatgccctggccgcgtgaagaagttatcaacaccactgtgcggctgcgcgccagccagtttaatttgcgggacgatcgcggtcagcctgtaccgtattttattcgccatgcccgtgagatcgatccaggcctaatcgatcggcaaatagttcattacggtaattacgatccctttatggagtttgatatacagatcaaccagattgtcccttctatgggctatcgcacgctttatatcgaagcgaatcagcctggcaacgtaattgcggcaaaaagtgacgctgaagggatactggaaaatgctttctggcaaattgcgctcaatgaggatggttctctgcaactggtagataaagacagcggtgtgcgctatgaccgggtattgcaaattgaagaaagctctgatgatggtgatgaatatgactattcacccgcaaaagaagagtgggtaattaccgcagcgaacgcgaaaccgcaatgcgatattattcatgaagcctggcagagcagggctgttatccgctatgacatggcagtgccgctcaatttgtcagaacgcagcgcccggcaatccactggcagagtaggggtggtgttggttgtcactcttagtcataacagcaggcgtattgatgtggatatcaatcttgataaccaggctgacgatcatcgccttcgtgtcctggtccctacaccttttaacaccgacagtgttctggcagatacgcagtttggttcgctaacgcgccccgtgaacgacagtgcaatgaacaactggcagcaagaaggctggaaagaagcgccggttccggtatggaatatgctcaactatgttgccttacaggaagggcgtaacggcatggctgtctttagcgaagggttacgtgaatttgaagtcatcggtgaagagaagaaaacctttgccattacgttgctgcgtggcgtgggcttactgggcaaagaagatctgcttttaaggcctgggcggccttcgggaattaaaatgccagtcccggactcacaactacgtggtctgctttcttgtcgcctaagtttattgagttataccggtacgccaaccgccgctggtgtagctcagcaggcgcgagcatggctgactccagtacagtgttacaacaaaatcccatgggatgtgatgaagctcaacaaagccggattcaacgtgccggaaagttatagtttgttgaaaatgcccccagtgggatgcctgataagcgcacttaagaaagctgaagaccgacaagaagtgattttacggctgtttaatccggctgaatcagcaacctgtgatgcgactgttgctttcagtcgcgaggtgatttcttgctcagaaacgatgatggatgaacacattaccaccgaggaaaatcaaggttcaaatctatcggggccttttttacccggccagtcacggacgttcagttaccggcttgcctgaatagcaatcaaaccgaagccacatatgcgcggccagattgttgacaaagggcgctttgttcatgccggatacggcatgaacgctttattcggtctacaaaagcaggcaaattcaatatattgcagagatgatgtagacactggcaagcgtagcgcatcaggtaattttgcgtttatcttcactctcaagccacgtatatgtggctttatttttaacaaaataataaccctgggtgagttaattataatataattataagttaactaaatgttaatattggcggggtggatttatgcctttattagtaatcctgaaactctgcgtcgtattagccagtgaccaaaaaaagaattaaggtcaaccgtgctgtttttgcttcgtctctttttatctttaattgccaaccgaaactaatttcagccttataactcacacattttaaacataaatgtcactaaagttaccttattgaaacatgattaacataatttgtaggaattgatatttatcaatgtataagtcttggaaatgggcatcaaaaagagataaattgttctcgatcaaattggctgaaaggcggtaatttagctataaattgatcaccgtcgaaaaatgcaaatttgcttcaacaaaaacctgtttattgtaaggattttgcggcgtaatatatacgtgggatcaatttgagtttttattaacatgtttgcaacctttctttacgccgtttttgtgtgcattcacatggtatgatgaaagtgttcaaacaaatttctattggggcatgcgtgtgaccctttctaacggggttcactctcggagtcttcatgcgatgagcaaggagtcatgatgttagatatagtcgaactgtcgcgcttacagtttgccttgaccgcgatgtaccacttcctttttgtgccactgacgctcggtatggcgttcctgctggccattatggaaacggtctacgtcctctccggcaaacagatttataaagatatgaccaagttctggggcaagttgtttggtatcaacttcgctctgggtgtggctaccggtctgaccatggagttccagttcgggactaactggtcttactattcccactatgtaggggatatcttcggtgcgccgctggcaatcgaaggtctgatggccttcttcctcgaatccacctttgtaggtctgttcttcttcggttgggatcgtctgggtaaagttcagcatatgtgtgtcacctggctggtggcgctcggttcaaacctgtccgcactgtggattctggttgcgaacggctggatgcaaaacccaatcgcgtccgatttcaactttgaaactatgcgtatggagatggtgagcttctccgagctggtgcttaacccggttgctcaggtgaaattcgttcacactgtagcgtctggttatgtgactggcgcgatgttcatcctcggtatcagcgcatggtatatgctgaaaggtcgtgacttcgccttcgctaaacgctcctttgctatcgctgccagcttcggtatggctgctgttctgtctgttattgttctgggtgatgaatccggctacgaaatgggcgacgtgcagaaaaccaaactggctgctattgaagccgagtgggaaacgcaacctgcgcctgctgcctttactctgttcggcattcctgatcaggaagaggagacgaacaaatttgcgattcagatcccttacgcactgggcatcattgcaacgcgttccgtggataccccggttatcggcctgaaagagctgatggtgcagcatgaagaacgcattcgtaacgggatgaaggcgtactctctgctcgaacaactgcgttctggttctaccgaccaggcggttcgtgaccagttcaatagcatgaagaaagacctcggttacggtctgctgctgaaacgctatacgccaaacgtggctgatgcgactgaagcgcagattcaacaggcaaccaaagactccatcccgcgtgtagcgccgctgtactttgcgttccgtatcatggtggcgtgtggcttcctgcttctggcaatcatcgcgctctctttctggagtgtcatccgcaaccgcattggcgagaaaaaatggcttctgcgcgccgcgctgtacggtattccgctgccgtggattgctgtagaagcgggctggttcgtggctgaatatggccgccaaccgtgggctatcggtgaagtgctgccgacagctgtggcgaactcgtcactgaccgcaggcgatctcatcttctcaatggtgctgatttgcggcctgtataccctgttcctggtggcagaattgttcttaatgttcaagtttgcacgcctcggcccaagcagcctgaaaaccggtcgctatcactttgagcagtcttccacgactactcagccggcacgctaagacaggagtcgtcaaatgatcgattatgaagtattgcgttttatctggtggctgctggttggcgttctgctgattggttttgcagtcactgacggtttcgacatgggggtgggcatgctcacccgtttcctcggtcgtaacgacaccgagcgtcgaattatgattaactccattgcaccacactgggacggtaaccaggtttggctgatcaccgcgggcggcgcactctttgctgcctggccgatggtctatgccgctgcgttctccggcttctatgtggcgatgatcctcgtgctggcgtctttgttcttccgtccggtcggttttgactaccgctccaagattgaagaaacccgctggcgtaacatgtgggactggggcatcttcattggtagcttcgttccgccgctggtaattggtgtagcgttcggtaacctgttgcagggcgtaccgttcaacgttgatgaatatctgcgtctgtactacaccggtaacttcttccagttgcttaacccgttcggcctgctggcaggcgtggtgagcgtagggatgatcattactcagggcgcaacctatctgcaaatgcgtaccgtgggcgaactgcacctgcgtacccgtgcaacggctcaggtggctgcgctggtgacactggtctgtttcgcactggctggcgtatgggtgatgtacggtatcgatggttatgtcgtgaaatcgacaatggaccattacgcagcctctaacccactgaataaagaagtggttcgtgaagctggcgcatggctggttaacttcaacaacacgccaattctgtgggctattccggcactgggtgtggttctgccgctgctgaccatcctgactgcacgtatggataaagccgcgtgggcgtttgtgttctcctccctgacgctggcctgcatcatcctgacagccggtatcgcaatgttcccgtttgtgatgccgtccagcaccatgatgaacgcaagtctgacaatgtgggatgcaacttccagccagctgacgcttaacgtcatgacctgggttgcggtggttctggtaccgatcattctgctctacaccgcctggtgttactggaaaatgttcggtcgtatcaccaaagaagatattgaacgtaacacccactctctgtactaagtaaggagctaaaaatgtggtatttcgcatggattctgggaacgcttcttgcctgttcgtttggggtaatcaccgcgctggcgcttgaacacgtcgaatcaggcaaagccggtcaagaagacatctgatgagtaagattatcgcgactttgtatgcggtaatggacaagcgccccctgcgggcgctttccttcgtgatggcgcttctgttagcaggatgtatgttttgggacccatctcgttttgccgcgaagaccagtgaactggaaatctggcatggtttattgctgatgtgggccgtctgtgctggtgtgattcacggcgtgggctttcgtccgcagaaggttctttggcaagggattttttgcccattgcttgccgatattgttctcattgtcgggctgattttcttcttcttttaaatcagaattctctttaaaaaattatgggccgctccaggcccataaatttttacgctcccttaacttgccctcattcccaaacctcaatcgcgcgcgtatagtagcagcgtttaaaagctctaacttttgttgcattaccgggatgtaaagtgaatacaacgctgtttcgatggccggttcgcgtctactatgaagataccgatgccggtggtgtggtgtaccacgccagttacgtcgctttttatgaaagagcacgcacagagatgctgcgtcatcatcacttcagtcagcaggcgctgatggctgaacgcgttgcctttgtggtacgtaaaatgacggtggaatattacgcacctgcgcggctcgacgatatgctcgaaatacagactgaaataacatcaatgcgtggcacctctttggttttcacgcaacgtattgtcaacgccgagaatactttgctgaatgaagcagaggttctggttgtttgcgttgacccactcaaaatgaagcctcgtgcgcttcccaagtctattgtcgcggagtttaagcagtgactgacatgaatatccttgatttgttcctgaaggctagccttctggttaaacttatcatgttgattttgattggtttttcaatcgcatcttgggccattattatccagcggacccgtattcttaacgcagcggcgcgcgaagccgaagcgtttgaagataaattctggtctggaatcgaactctctcgcctctatcaagagagccaggggaaacgggataatctgactggttcggaacaaatcttttacagcgggttcaaagagtttgtgcgcctgcatcgtgccaatagccatgcgccggaagccgtagtggaaggggcgtcgcgtgctatgcgtatctccatgaaccgtgaacttgaaaatctggaaacgcacattccgttcctcggtacggttggctccatcagcccgtatattggtctgtttggtacggtctgggggatcatgcacgcctttatcgccctcggggcggtaaaacaagcaacactgcaaatggttgcgcccggtatcgcagaagcgttgattgcgactgcaattggtctgtttgccgctatcccggcagttatggcctacaaccgcctcaaccagcgcgtaaacaaactggaactgaattacgacaactttatggaagagtttaccgcgattctgcaccgccaggcgtttaccgttagcgagagcaacaaggggtaagccatggccagagcgcgtggacgaggtcgtcgcgatctcaagtccgaaatcaacattgtaccgttgctggacgtactgctggtgctgttgctgatctttatggcgacagcgcccatcatcacccagagcgtggaggtcgatctgccagacgctactgaatcacaggcggtgagcagtaacgataatccgccagtgattgttgaagtgtctggtattggtcagtacaccgtggtggttgagaaagatcgcctggagcgtttaccaccagagcaggtggtggcggaagtgtccagccgtttcaaggccaacccgaaaacggtctttctgatcggtggcgcaaaagatgtgccttacgatgaaataattaaagcactgaacttgttacatagtgcgggtgtgaaatcggttggtttaatgacgcagcctatctaaacatctgcgtttcccttgcttgaaagagagcgggtaacaggcgaacagtttttggaaaccgagagtgtcaaaggcaaccgaacaaaacgacaagctcaagcgggcgataattatttcagcagtgctgcatgtcatcttatttgcggcgctgatctggagttcgttcgatgagaatatagaagcttcagccggaggcggcggtggttcgtccatcgacgctgtcatggttgattcaggtgcggtagttgagcagtacaaacgcatgcaaagccaggaatcaagcgcgaagcgttctgatgaacagcgcaagatgaaggaacagcaggctgctgaagaactgcgtgagaaacaagcggctgaacaggaacgcctgaagcaacttgagaaagagcggttagcggctcaggagcagaaaaagcaggctgaagaagccgcaaaacaggccgagttaaagcagaagcaagctgaagaggcggcagcgaaagcggcggcagatgctaaagcgaaggccgaagcagatgctaaagctgcggaagaagcagcgaagaaagcggctgcagacgcaaagaaaaaagcagaagcagaagccgccaaagccgcagccgaagcgcagaaaaaagccgaggcagccgctgcggcactgaagaagaaagcggaagcggcagaagcagctgcagctgaagcaagaaagaaagcggcaactgaagctgctgaaaaagccaaagcagaagctgagaagaaagcggctgctgaaaaggctgcagctgataagaaagcggcagcagagaaagctgcagccgacaaaaaagcagcagaaaaagcggctgctgaaaaggcagcagctgataagaaagcagcggcagaaaaagccgccgcagacaaaaaagcggcagcggcaaaagctgcagctgaaaaagccgctgcagcaaaagcggccgcagaggcagatgatattttcggtgagctaagctctggtaagaatgcaccgaaaacggggggaggggcgaaagggaacaatgcttcgcctgccgggagtggtaatactaaaaacaatggcgcatcaggggccgatatcaataactatgccgggcagattaaatctgctatcgaaagtaagttctatgacgcatcgtcctatgcaggcaaaacctgtacgctgcgcataaaactggcacccgatggtatgttactggatatcaaacctgaaggtggcgatcccgcactttgtcaggctgcgttggcagcagctaaacttgcgaagatcccgaaaccaccaagccaggcagtatatgaagtgttcaaaaacgcgccattggacttcaaaccgtaatcgcgatgttgactgttcggacggtcaacatcaggcaccggttgccacggggttctggtagttttgtgtattttagtttgttaacattctgctaaattatcgtgggccatcggtccagataagggagatatgatgaagcaggcattacgagtagcatttggttttctcatactgtgggcatcagttctgcatgctgaagtccgcattgtgatcgacagcggtgtagattccggtcgtcctattggtgttgttcctttccagtgggcggggcctggtgcggcacctgaagatattggcggcatcgttgctgctgacttgcgtaacagcggtaaatttaatccgttagatcgcgctcgtctgccacagcagccgggtagtgcgcaggaagtacaaccagctgcatggtccgcactgggcattgacgctgtagttgtcggtcaggtcactccgaatccggatggttcttacaatgttgcttatcaacttgttgacactggcggcgcaccgggtactgtacttgctcagaactcgtacaaagtgaacaagcagtggctgcgttatgctggtcataccgccagtgatgaagtgtttgaaaaactgaccggcattaaaggtgcgttccgtactcgtattgcctacgttgttcagaccaacggcggtcagttcccgtatgaactgcgcgtatctgactatgacggttacaaccagtttgtcgttcaccgttcaccgcagccgctgatgtctccggcgtggtcaccagacggttctaaactggcttatgtgaccttcgaaagcggtcgttccgcgctggttattcagacgctggcaaatggcgctgtacgtcaggtggcttcattcccgcgtcacaacggtgcacctgcattctcgccagacggcagcaaactggcattcgccttgtcgaaaaccggtagtctgaacctgtacgtaatggatttggcttctggtcagatccgccaggtgactgatggtcgcagtaacaataccgaaccgacctggttcccggatagccagaacctggcatttacttctgaccaggccggtcgtccgcaggtttataaagtgaatatcaacggcggtgcgccacaacgtattacctgggaaggttcgcagaaccaggatgcggatgtcagcagcgacggtaaatttatggtaatggtcagctccaatggtgggcagcagcacattgccaaacaagatctggcaacgggaggcgtacaagttctgtcgtccacgttcctggatgaaacgccaagtctggcacctaacggcactatggtaatctacagctcttctcaggggatgggatccgtgctgaatttggtttctacagatgggcgtttcaaagcgcgtcttccggcaactgatggacaggtcaaattccctgcctggtcgccgtatctgtgataataattaattgaatagtaaaggaatcattgaaatgcaactgaacaaagtgctgaaagggctgatgattgctctgcctgttatggcaattgcggcatgttcttccaacaagaacgccagcaatgacggcagcgaaggcatgctgggtgccggcactggtatggatgcgaacggcggcaacggcaacatgtcttccgaagagcaggctcgtctgcaaatgcaacagctgcagcagaacaacatcgtttacttcgatctggacaagtacgatatccgttctgacttcgctcaaatgctggatgcacatgcaaacttcctgcgtagcaacccgtcttacaaagtcaccgtagaaggtcacgcggacgaacgtggtactccggaatacaacatctccctgggtgaacgtcgtgcgaacgccgttaagatgtacctgcagggtaaaggcgtttctgcagaccagatctccatcgtttcttacggtaaagaaaaacctgcagtactgggtcatgacgaagcggcatactccaaaaaccgtcgtgcggtactggtttactaagagaattgcatgagcagtaacttcagacatcaactattgagtctgtcgttactggttggtatagcggccccctgggccgcttttgctcaggcaccaatcagtagtgtcggctcaggctcggtcgaagaccgcgtcactcaacttgagcgtatttctaatgctcacagccagcttttaacccaactccagcaacaactttctgataatcaatccgatattgattccctgcgtggtcagattcaggaaaatcagtatcaactgaatcaggtcgtggagcggcaaaagcagatcctgttgcagatcgacagcctcagcagcggtggtgcagcggcgcaatcaaccagcggcgatcaaagcggtgcggcggcatcaacgacgccgacagctgatgctggtactgcgaatgctggcgcgccggtgaaaagcggtaatgcaaacacggattacaatgcagctattgcgctggtgcaggataaatcccgccaggatgacgcaatggtggcatttcagaatttcatcaaaaattaccctgattcaacttacctgccaaacgccaattattggctgggtcagttaaactacaacaagggtaaaaaagatgatgcggcgtactattttgcttcggtagtgaaaaactatccgaagtcaccaaaggctgcagatgcgatgtttaaagtcggcgtcatcatgcaggacaaaggtgacaccgcaaaagcgaaagccgtataccagcaggttatcagtaaataccctggtactgatggcgctaaacaggcacaaaaacgtctgaacgcgatgtaatgcataacacacgaccagaagtcgcattatttctggtcgtgtcgtgcgaatcataagcagttgagtgatctacatcgaaatttttgttgcgctcaagtctgaaatcagtaatatatgccgccgttgccacgggatatcaaacaaaccgaaagcaacgaaaaagtgggtcgttagctcagttggtagagcagttgacttttaatcaattggtcgcaggttcgaatcctgcacgacccaccaatcgctaaggtggaagcggtagtaaaacgtgaaggataacgttgcatgagcaacggcccgaagggcgagacgaagtcgagtcatcctgcacgacccaccactaacatagttagttgtagtatccagcgtagtatcgggtgattagctcagctgggagagcacctcccttacaaggagggggtcggcggttcgatcccgtcatcacccaccaccgggtcgttagctcagttggtagagcagttgacttttaatcaattggtcgcaggttcgaatcctgcacgacccaccagttttaacatcgaagacagatgttaagcgtgtaggataacgttgcgtcagcaacggcccgtagggcgagcgaagcgagtcatcctgcacgacccaccactaatgacggtgggttcggtggaagtagtttgtagtatccagcgcagtatcgggtgattagctcagctgggagagcacctcccttacaaggagggggtcggcggttcgatcccgtcatcacccaccactcgggtcgttagctcagttggtagagcagttgacttttaatcaattggtcgcaggttcgaatcctgcacgacccaccagttttaacatcaaactcagatgttaagcgtgaaggataacgttgcgccagcaacggcccgtagggcgagcgaagcgagtcatcctgcacgacccaccaatcttaaagattggccccgagtaaaaatctttcaggtaacacccgtatgggtcgttagctcagttggtagagcagttgacttttaatcaattggtcgcaggttcgaatcctgcacgacccaccaatttaaaggtggttactggtagagaacgtgaaggataacgttgcgttagcaacggcccgaagggcgagacgaagtcgagtcatcctgcacgacccaccatcctgaatgattaaggcagcataatcccgcaaggggtcgttagctcagttggtagagcagttgacttttaatcaattggtcgcaggttcgaatcctgcacgacccaccaatgtaaaaaagcgccctaaaggcgcttttttgctatctgcgatactcaaagattcgaacctgcagcaggtttgagttgagcgcagcgaaacaacggagccgctcgcggcgacggcccgaagggcgagcgaagcgagtcatcctgcacgacccaccaatgtaaaaaagcgccctaaaggcgcttttttgctattcaggcatcctcaatttcactttgtaaacctgatgacatcgtcagagcttactgtgcaagcaactctatgtcggtggaattaggcgtaaaatgacgcatcctgcacattaggcgtaattcgagtgacttttccccaccattcgactatcttgtttagcatataaaacaaattacaccgataacagcgaatattacgctaatgtcggttttaacgttaagcctgtaaaacgagatggtaagatgagcgtaatgtttgatccagacacggcgatttatcctttccccccgaagccgacgccgttaagcattgatgaaaaagcgtattaccgcgagaagataaaacgtctgctaaaagaacgtaatgcggtgatggttgcccactactataccgatcccgaaattcaacaactggcagaagaaaccggtggctgtatttctgattctctggaaatggcgcgcttcggtgcaaagcatcccgcttctactttgttagtcgctggggtgagatttatgggagaaaccgccaaaattctcagtccggaaaaaacaattctgatgccgacacttcaggctgaatgttcactggatctcggctgccctgttgaagaatttaacgcattttgcgatgcccatcccgatcgtactgtcgtcgtctacgccaacacttctgctgcggtaaaagcgcgcgcagattgggtggtaacttcaagcattgccgtcgaacttattgatcatcttgatagtttgggtgaaaaaatcatctgggcacccgacaaacatctggggcgttacgtgcaaaaacagacgggtggagacattctatgctggcagggtgcctgtattgtgcatgatgaatttaagactcaggcgttaacccgcttgcaagaagaatacccggatgctgccatactggtgcatccagaatcaccacaagctattgtcgatatggcggatgcggtcggttccaccagtcaactgatcgctgctgcgaaaacattgccacatcagaggcttattgtggcaaccgatcggggtattttctacaaaatgcagcaggcggtgccagataaagagttactggaagcaccaaccgcaggtgagggtgcaacctgccgcagctgcgcgcattgtccgtggatggccatgaatggccttcaggccatcgcagaggcattagaacaggaaggaagcaatcacgaggttcatgttgatgaaaggctgcgagagagggcgctggtgccgctcaatcgtatgctggattttgcggctacactacgtggataacgaataataaggcgtaacgttacgctttgggggaaagatggatttttttagtgtgcagaatatcctggtacatataccaataggggcaggcggttatgatctctcatggatcgaagcggtaggcacgatcgccgggttgctgtgtattggccttgccagtctggagaagatcagcaactacttctttggcctgatcaacgtcaccttgtttggcattattttctttcagattcagctgtatgccagcctgctattacaggtgtttttctttgccgcgaatatttacggttggtatgcgtggtcgcgacaaaccagtcagaacgaggcggagttgaaaattcgctggttgccattgccgaaggcactcagctggttggcggtttgcgttgtttcgattggtctgatgacggtatttatcaatccggtgtttgcatttttgacccgcgtggcagtcatgatcatgcaagcattaggattacaggttgtgatgcctgaactgcaaccggacgctttcccgttctgggattcatgcatgatggtgttatctatcgtggcaatgattctgatgacgcgtaagtatgtggaaaactggctgttgtgggtgattattaacgtgattagcgtcgttatttttgcacttcagggcgtttacgccatgtctctggagtacatcatcctgacctttattgcgctcaacggcagccggatgtggatcaacagcgcacgtgaaagaggctcacgcgcgctgtcccattaatggtgatgatgtgaatggccagacaccccttcattcaggtggcagtctggcccatgacaaggttgatattccatctgaatggtggcgtgctcaatctgatagtgatccatcaggtagtgttggatctgatccaacaaggcatcgtgatcgtgtggcgggatcacctgcacatgcaacgtcatcaccggcttctcgcctaccatccatacatgtacatggtgcacattgcggacttccgggatttcccggcacatacgacgcttcagttcagcgatatccagcgataccggtgcaccttcaagtaattcattcacgctatctttcaacagtcgccacgcgctacgcagaaccagaagcgacaccagtatcgagagaatggggtcagcaggtgtccagccagtccagataataatcaacgcggcaataatagccccaaccgaacccagcaggtccccgagcacatgcagtgccgctgctcgtacgttgaggtttttctcttcgctgccgtgatgaagtaaccagaaagaaagtatatttgccagcaacccagccacggcaattgccatcatcatgccgccctcgaccggacgcggcgtgcggaagcgttctatcgcctcccagacaatcaaaatggtaattaccacgagggctatggcattcacaaacgccgcgagcgtggtcagtcttagccaaccgaaagtgtggcgaatggtgggaggacgacgtgaaaattgcacggcgagtagggcgaaaagcagggcggcagtatcggtcaacatatgacccgcatcggccagcaatgccagagaaccagaaagaaaaccaccaacgacttctaccagcataaacccggcagtcacgccgaaagcatacaacaagcgacgagcattattatcttctggcaggtgtgaggacgtgtgtgagtgtgagtgcgccatgacgagtcatcccttaattattctcacttaactttatgacatcatactgcttttagaagtgaaaaattaaaagggagagactccgctctcccattattggctattttgcagggttactgcgtggtaccgtcggttttggtatcgacatcattattgatgccatcaccggtttgtacctttttattgatatccggacagcgaccatctttgcacatggtgttcttgtgctcttcatctttggtcattccgtcattgttcattgaagaaccatccgaatgcagcattgtgccgccagaaccggtatttaccccgttattgtcgacgttatttggcgcgacattttcacgggcgtcaggggctacctggcccgcatcagctgcggcgtttgcctggccgttattagtttgcgctccgctatcggcagccagtgcggcaccgctggcaaggcttagagtggcagtcagaaataatgtggccagttttgtcattttcataggatgctcctgttatggtcgttatgtcggataacctcttccaacagtgcatttgcaggtgaatataaggcattggtttaagatttcagccaggttatgaaacgcagcagagaatcttgaaataattaacaaacaaaggagttacagttagaaattgtaggagagatctcgtttttcgcgacaatctggcgtttttcttgctaattccaggattaatccgttcatagtgtaaaaccccgtttacacattctgacggaagatatagattggaagtattgcattcactaagataagtatggcaacactggaacagacatgaattatcagaacgacgatttacgcatcaaagaaatcaaagagttacttcctcctgtcgcattgctggaaaaattccccgctactgaaaatgccgcgaatacggttgcccatgcccgaaaagcgatccataagatcctgaaaggtaatgatgatcgcctgttggttgtgattggcccatgctcaattcatgatcctgtcgcggcaaaagagtatgccactcgcttgctggcgctgcgtgaagagctgaaagatgagctggaaatcgtaatgcgcgtctattttgaaaagccgcgtaccacggtgggctggaaagggctgattaacgatccgcatatggataatagcttccagatcaacgacggtctgcgtatagcccgtaaattgctgcttgatattaacgacagcggtctgccagcggcaggtgagtttctcgatatgatcaccccacaatatctcgctgacctgatgagctggggcgcaattggcgcacgtaccaccgaatcgcaggtgcaccgcgaactggcatcagggctttcttgtccggtcggcttcaaaaatggcaccgacggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcacaggtgatgatcgatttcagccatgctaactcgtccaaacaattcaaaaagcagatggatgtttgtgctgacgtttgccagcagattgccggtggcgaaaaggccattattggcgtgatggtggaaagccatctggtggaaggcaatcagagcctcgagagcggggagccgctggcctacggtaagagcatcaccgatgcctgcatcggctgggaagataccgatgctctgttacgtcaactggcgaatgcagtaaaagcgcgtcgcgggtaaggtttaattgtcggatgcgccgtcagagtggcgtatccgatgaatcaccacaggcctgataagtcgcgcagcgtcgcatcaggcaatgtgctccattgttagcaacaaaaaagccgactcacttgcagtcggctttctcattttaaacgaatgacgtttacttcgctttaccctggtttgcaaccgccgctgctttcgctgcgatctcgtcagcattacccagataatagcgtttcagcggtttgaaattctcgtcgaactcatacaccagcggcacgccagtcgggatattaagctcaagaatctcttcttcgctcatgttatcaagatatttcaccagcgcacgtaaagagttaccgtgtgcagcgatgatcacgcgctcaccgctcttcatacgcggcagaatagtttcattccagtaagggatcacgcggtcaatggtcagcgccaggctttccgtcagcggcagttctttctcgctcagtttcgcgtaacgcggatcgtgacccggataacgctcatcatctttagtcagttccggcggagtcactgcaaaaccacgacgccactgtttcacctgctcgtcgccatacttttcagcagtttccgctttgttcagaccctgcaacgcaccgtagtgacgttcgttcagtttccaggatttctcaacgggcagccatgcctgatccagttcgtccagcacattccacagggtatggatagcgcgtttcagcacagaagtgtaagcaaagtcaaagctgtaaccttcctctttcagcagcttacctgctgcttttgcttcgcttacgcctttctcagacagatccacgtcgtaccaaccggtgaaacggttttctttgttccactgactttcgccatgacgaaccagaaccagcttagttacagccatatacttactcctcaaatcatcttttaatgataataattctcattatattgccgcgacgaagcaacagcaatgcttacgcataaccatagcgaaaatagtggcgcagtgtaaggttgttgtgaatattgagttgcaaatatgtcggtgtttgctggtgatttgaacaatatgagataaagccctcatgacgagggcgtaacattactcagcaataaactgatattccgtcaggctggaatactcttcgccaggacgcaggaagcagtccggttgcggccattcagggtggttcgggctgtccggtagaaactcgctttccagagccagcccttgccagtcggcgtaaggttcggttccccgcgacggtgtgccgccgaggaagttgccggagtagaattgcagagccggagcggtggtgtagaccttcagctgcaatttttcatctgctgaccagacatgcgccgccactttcttgccatcgcctttggcctgtaacaagaatgcgtgatcgtaacctttcactttgcgctgatcgtcgtcggcaagaaactcactggcgatgattttggcgctgcggaaatcaaaagacgttccggcgacagatttcaggccgtcgtgcggaatgccgccttcatcaaccggcagatattcgtccgccagaatctgcaacttgtgattgcgcacgtcagactgctcgccgtcaagattgaaatagacgtgattagtcatattcaccgggcaaggtttatcaactgtggcgcgataagtaatggagatacggttatcgtcggtcagacgatattgcaccgtcgcgccgagattacccgggaagccctgatcaccatcatctgaactcagggcaaacagcacctgacgatcgttctggttcacaatctgccagcgacgtttgtcgaacccttccggcccgccgtgcagctggttaacgccctgacttggcgaaagcgtcacggtttcaccgtcaaaggtataacggctattggcgatacggttggcataacgaccaatagaggcccccagaaacgcggcctgatcctgatagcattccgggctggcacagccgagcagcgcctcgcggacgctgccatcggaaagcggaatacgggcggaaagtaaagtcgcaccccagtccatcagcgtgactaccatccctgcgttgttacgcaaagttaacagtcggtacggctgaccatcgggtgccagtgcgggagtttcgttcagcactgtcctgctccttgtgatggtttacaaacgtaaaaagtctctttaatacctgtttttgcttcatattgttcagcgacagcttgctgtacggcaggcaccagctcttccgggatcagcgcgacgatacagccgccaaatccgccgccggtcatgcgtacgccacctttgtcgccaatcacagctttgacgatttctaccagagtgtcaatttgcggcacggtgatttcgaaatcatcgcgcatagaggcatgagactccgccatcaactcgcccatacgtttcaggtcgccttgctccagcgcgctggcagcttcaacggtgcgggcgttttcagtcagtatatgacgcacgcgttttgccacgatcgggtccagttcatgcgcaacagcgttgaactcttcaatggtgacatcacgcagggctggctgctggaagaaacgcgcaccggtttcgcactgttcacgacgggtgttgtattcgctgccaaccagggtacgtttgaagttactgttgatgatgacgacagccacacctttgggcatggaaactgctttggtccccagtgagcggcaatcgatcagcaaggcatgatctttcttgccgagcgcggaaattagctgatccatgatcccgcagttacagcctacaaactggttttctgcttcctgaccgttaagcgcgatttgtgcgccgtccagcggcagatgataaagctgctgcaatacggttccgaccgcgacttccagtgaagcggaagaacttaacccggcaccctgcggcacattgccgctgatcaccatgtccacgccgccgaagctgttgttacgcagttgcagatgtttcaccacgccacgaacgtagttagcccattgatagttttcatgtgcgacaatgggcgcatcgagggaaaactcgtcgagctgattttcataatcggctgccatcacgcgaactttacggtcatcgcgtggtgcacaactgatcacggtttgataatcaatcgcgcagggcagaacgaaaccgtcgttgtagtcggtgtgttcaccaatcaaattcacgcggccaggcgcctgaatggtgtgagtggcagggtagccaaatgcgttggcaaacagagattgtgttttttctttcagactcatttcttacactccggattcgcgaaaatggatatcgctgactgcgcgcaaacgctctgctgcctgttctgcggtcaggtctcgctgggtctctgccagcatttcataaccaaccataaatttacgtacggtggcggagcgcagcagaggcggataaaagtgcgcgtgcagctgccagtgttgattctcttcgccattaaatggcgcgccgtgccagcccatagagtaggggaaggagcactggaagaggttgtcataacgactggtcagctttttcaacgccagcgccagatcgctgcgctgggcgtcggtcaaatcggtgatccgtaaaacgtgggctttgggcagcagtagcgtttcgaacggccaggcagcccagtaaggcacgacggctaaccagtgttcggtttcgacaacggtacggctaccgtctgccagctcgcgctgaacataatccaccagcattggtgatttctgttcggcaaaatattctttttgcaggcggtcttcgcgctcagcttcgttaggcaggaagctatttgcccaaatctgaccgtgcggatgcgggttagagcagcccatcgccgcgcctttgttttcaaaaacctgcacccatgggtacgttttccccagttctgcggtttgctcctgccaggttttgacgatttccgtcaatgctgcaacgctgagctctggcagcgttttactgtgatccggtgaaaagcagatcacccggctggtgccgcgcgcgctctggcaacgcatcagcggatcgtgactttctggcgcatctggcgtgtcagacatcaaagccgcaaagtcattagtgaaaacgtaagtcccggtgtaatcggggtttttatcgcctgtcacccgcacattacctgcgcagaggaagcaatctggatcgtgcgcaggtaacacctgtttggctggcgtttcctgcgccccctgccaggggcgcttagcgcggtgcggtgaaaccagaatccattgcccggtgagcgggttgtagcggcgatgtggatgatcaacgggattaaattgcgtcatggtcgttccttaatcgggatatccctgtggatggcgtgactgccagtgccaggtgtcctgcgccatttcatcgagtgtgcgcgttacgcgccagttcagttcacggtcggctttgctggcgtccgcccagtaggccggaaggtcgccctcgcgacgcggtgcaaaatgataattaaccggtttgccgcaggctttgctgaaggcattaaccacgtccagcacgctgttgcctacgccagcgccgaggttgtagatgtgtacgcctggcttgttcgccagtttttccatcgccacgacgtgaccgtccgccagatccattacgtggatgtaatcgcgtacgccagtaccatcttcggtcggataatcgttaccaaaaatcgccagcgagtcgcgacggcctacagcaacctgggcgatgtatggcatcaggttattcggaatgccttgcggatcttcgcccatatcgcccgacggatgcgcgccaaccgggttgaagtagcgcagcagggcaatgctccagtccggctgggctttttgcagatcggtgaggatctgttccaccatcagcttgcttttgccgtaagggctttgcggtgtgccggtcgggaagctttcaacgtatggaattttgggctgatcgccataaacggtggcggaggagctaaaaataaagtttttgacgttagcggcgcgcatggcgctaatcaggcgcagagtgccgttgacattgttgtcgtaatattccagcggtttttgtaccgattcgcccacggctttcagcccggcgaagtggatcacggtgtcgatagcgtgatcgtgcaggatctcggtcatcaacgcttcgttacgaatatcgccttcaacaaacgttggatgtttgccgcctaaacgctcgataacaggcagtacgctgcgcttactgttacagaggttatcaagaatgatgacatcatgaccgttttgcagtaattgcacacaggtatgacttccaatgtaaccgctaccaccggtaaccagaactctcataattcgctccattaggcttatggtatgaaataaccatagcataacaaagatgcgaaaagtgtgacatggaataaattagtggaatcgtttacacaagaatttagccgttttttatgcgcgattaagtgattataaaacagagggtttatgaatgattgcgctttttatctgaaaaaagacgcggtttcatgcctgcatgcgtcgaaccgttggccggagagggtgctaaggccgcctccggcaaggtcagcactaccgactcaatatatttttgtcagcacatagcgatagagtccaccgtccggcacgaactcaagacgatgggtaatacaggcaggcgcatcttcagcgtggtgcgaaacaaacaacaattgcgtttcaccttcgctaatcagcacatcaacaaaacggcggataagctggcgattcagcggatcaagcccctgtagtggttcatcgagaataagcaacgtcggatgtttcaccagtgcgcggacaatcagcgccagacgctgctgtccccaggaaagactatggaacggagcgtcagccgtgcgtttatcaatgccgagaatatccagccactgctgcaccagtttttgctggcgatccgaaacggcctgataaatgccaatcgaatcaaaatagccagaaagaatcacattacgcacggtagtgctgacccggtaatccagatgcaaactactgctgacgtaaccgatatgctttttgatatcccagatggtttcgccgctgccgcgacgtcgtccgaaaagcgtcaaatcgttgctgtaaccttgcggatgatcgccagtaaccaggcttaataacgtcgattttcctgcaccatttggcccgacaatttgccagtgttcgcctggattcacctgccagctaaggttattaagaatggggcgatcgttataagaaaccacgccattgttcagcacaatgcgcggttcgttggcgggtaaggcgtgacgtgctgaaggttcatccggctccggcagttgcacaccttcaagctgttcactatgcgccagttgcgcgacgagtgcttgttggagcagttcctctttagcgccagtttccgctaacgtgcaatccgccagcacgccagcaaactggacaaactccgggatctcatcgaagcgattgagcaccagtaccagagtaataccggactgatgtaacgaggcgagtcgctcagccagctgctgacgtgaggcaacatccaggccatcgaacggctcatcaagaatcaacaagtcaggctccgacatcagcgcctgacacagcagggtttttcgcgtctcgccagtggaaaggtatttaaagcgtcggtcgaggagggcggtaataccgaactgctgcgccagttgcatgcaacgcggtgcatcctttacttcatcctgaatgatctcagccgtagtgcgtccggtgtcatcttcgccagggccgagcatatcggtgttattccgctgccattcgtcgctgacgagtttttgcaattgctcgaaggagagacgagtgatgtgggaaaactggctttgccgttcacctttcaaaagcggaagttcccccgccagcgcgcgggccagggccgatttcccgcttccattcgaaccgacaaacgcccaactatcacccgcgtttaacgttagctgaggcaattgcagcgtttttgtgtcgctaagacgaaacgtgccttgcaaaatttgcaacgatgacattttatatcccactttgtgcagcgattactgacagggatacgtgtttcataacaaattgtcaacacgcttagcacagcgtggcgataatcacgctgtcggcattaaagtaggccgtgacattctgtccttgctgaagagaagtcgcttcatttaccggcactgtggcgcacagtgtttgcccgtcgggtagcgccattaatacttcgcactgctctgcgccgcgctcaatatgactaataatacccggtaattggttgtcagcgttttgcgcgaccgcctcgtcctgagtaatacctacccacggcgcttttagcaatatcaacacttctttgccttcatccagccccagacgcgcgccgctttgtgcggtaattgcgactttcaggcgtgtttttccgtcagccagtaagacatcaacatgctgttgaacgtcatcatgatcgcgggcggtgatggtaccgaaccactggttacgggcgctggtttgcagtgaaaaacgtgagatcgcggccagcaggctgttcagcggcagggcgtcatcgtcacttaacacatcaaaggctttttgctggatttgcgccagtaagtcatagagctgaatcagtcgctgaccatagcgggtcagtactgcgccgccgccacctttaccgcctgttgcgcgctcgaccagaatatgctcacttaactgattcatctcgttaatggcatcccaggcgcttttatagctaataccggcatctttcgctccctggctaatggaaccggaaagcgcaatgtgttttagtagcgaaatgcggcgcgggtcggcgaataatttttgttggagcttaagggtgagaaggatttcggcctgcataacaatgtcctggcaaaagtcttattgtgacggaaaacgaacgccacgcaaagctgaccgcacaaaaggggagtgcttttctgtgcttagcggttagaatagtctcatgactatatctggagttgaccatgttagagttattaaaaagtctggtattcgccgtaatcatggtacctgtcgtgatggccatcatcctgggtctgatttacggtcttggtgaagtattcaacatcttttctggtgttggtaaaaaagaccagcccggacaaaatcattgattccctgaatgcccgcttagtcgggcattttctttttctcaacttcctgcttttcctgccgatattttttcttatctacctcacaaaggttagcaataactgctgggaaaattccgagttagtcgttatattgtcgcctacataacgttacattaaggggttaccaatggctcgtaaatggttgaacttgtttgccggggcggcactctctttcgctgttgctggcaatgcactggcagatgaagggaaaatcacggtgttcgccgccgcatcactgactaacgcaatgcaggacattgctacgcagtttaaaaaagagaaaggcgtggatgtggtttcttctttcgcttcgtcatctactctcgcccgtcagattgaagcgggtgcgcctgcggatctgtttatttctgccgatcagaaatggatggattatgcggttgataaaaaagcgatcgatacagctacgcgtcagacactgctcggcaatagcctggtcgttgtagcaccgaaagccagcgtgcagaaagatttcaccatcgacagcaaaaccaactggacttcactgctgaatggcggtcgcctggcggttggcgatccggaacatgttcccgctggcatttatgcaaaagaagcactgcaaaaactgggcgcatgggatacgctctctccgaaactggccccagcggaagatgttcgtggggcgctggcgctggtcgaacgtaacgaagcgcctctgggcattgtctacggttctgacgcagttgccagcaaaggggtaaaagtggttgccaccttcccggaagattcacataaaaaagtggaatatccggttgctgttgtggaagggcataacaatgcgacagtgaaagcattttatgattatctgaagggaccgcaggcagcggaaatctttaaacgttacggatttacaatcaagtaatgatactgaccgatccagaatggcaggcagttttattaagcctgaaagtttcttccctggctgtgctgtttagcctgccgtttgggatcttttttgcctggttactggtgcgttgcacgtttccgggcaaagctctgctcgacagcgtactgcatctaccgctggtgttaccgcccgtggtcgtcggttacttattattagtttcgatgggacggcgcggatttatcggtgaacgtctgtatgactggtttggtattaccttcgcctttagctggcgcggcgcggttctcgctgccgccgtcatgtcgtttccgctgatggtgcgggcaattcgtctggcgctggaaggggttgatgtcaaactggaacaggccgcaagaacactgggggccgggcgctggcgcgttttctttactatcacgttaccgctgaccttaccgggaattattgttggtacggtactggcttttgctcgttctctcggtgagtttggtgcaaccatcacctttgtgtcgaacattcctggtgaaacgcgaaccattccttctgccatgtataccctgatccagacccccggcggggaaagtggagcggcgagactgtgcattatttctattgcgctggcgatgatctccctgttgatttcagaatggctggccagaatcagccgtgaacgggcggggcgctaatcatgctggaactgaatttttcccagacgttgggcaaccattgcctgactattaatgaaacgctgcccgccaatggcatcactgctatctttggcgtctccggtgccggaaaaacttcgctgattaacgccatcagtggactgacgcgcccgcaaaaagggcggattgtcctcaatgggcgggtactaaatgatgccgaaaaaggtatctgcctgacgccggaaaagcgtcgcgttggctatgtttttcaggatgcgcggctgttcccgcattacaaagtgcgtggcaatctgcgctacggcatgtcgaaaagtatggtcgatcagttcgataagctggtggcgcttttaggcattgaaccgttgcttgaccgtttaccaggcagcctgtccggaggcgaaaaacagcgcgtggcgattggtcgggctttgctgacagcaccggaattgctgttgctggatgaaccgctggcgtcactggatattccgcgtaaacgcgaactgttgccttatctgcaacggctgacacgggaaatcaacattccgatgttgtatgtcagccattcgctggatgagatcctccatctggcagacagagtgatggtactggaaaacggtcaggtgaaagcctttggcgcgctggaggaagtgtggggcagtagcgtgatgaatccgtggctgccgaaagagcaacaaagtagcattctgaaagtgacggtgcttgagcatcatccgcattacgcgatgaccgcgctggcgctgggcgatcagcatttgtgggtcaataagctggacgaaccgctgcaagctgcgctacgtatccgcattcaggcttccgatgtttctctggttttacaaccgccgcagcaaaccagcattcgtaacgtattgcgggcaaaagttgttaatagttatgacgacaacggccaggtggaagtggaactggaagtcggcggtaaaacgctgtgggcgcgtatcagcccgtgggccagggatgaactggcgatcaaacctggcctgtggctgtacgcgcaaattaaaagtgtgtcgataaccgcctgattaaatcaggtggctataaatgaactgggcaatgctgtcggtggtgttatcaccaatcacaatgttggcgcgcgcttttaccgcgtcatcggcgttgcccatcgccacgcctgtaccagcggcttccagcatactgatatcattaaagttatcgccgaatgccacgacgttttccatcgaccaaccttgcgcctcaacccatttcgtcaaacgtttacctttgctgttgccgccgcgtgcaatatcaacctgatcgtgccaggaccattcacactccagtcccagttcatgttcgacatgcttaccaaaatgctgcaattgcggcaggtcatcgtgcgtcagggcgaacttccatacggcgttaacttgttgcgccgtttcagccagagaagcgacttgtgtgaaagtcggacgctgttccggcggcagggtttgcgcccagttagatgtgcgaatgacatgcccggtcgggtgctcatagaccattgcatcatcgacatacatcagaccgtgaatgtggtgttcattcagcatctcaatgagttgcagggctttaataacgggcattgggtccgcttccagcacggtttttgcatgataatcatacaaataggtgccattacagcaaatagcaggtgtatccagcgccagcgcctgataaaaaggatgaatagcgacgtgatggcgacctgtgacgatgattaattgatagcctgcttcgcgagcgcgggccagggcttctatcgatgaaggaagcagggtctttttcggggtcaataaggtgccgtctaagtcgagagcaatcacgcgtgtggtcatggcgtattccagattaaggttaagaattttcgtctgcgcgaatggtacaccgataccactatcggacaaaattctgcgttttaattcagcattcaccgccaaaagcgactaattttagctgttacagtcagttgctaaatgcaaaggagcattcatgaagcaaacagtttatatcgccagccctgagagccagcaaattcacgtctggaatctgaatcatgaaggcgcactgacgctgacacaggttgtcgatgtgccggggcaggtgcagccgatggtggtcagcccggacaaacgttatctctatgttggtgttcgccctgagtttcgcgtcctggcgtatcgtatcgccccggacgatggcgcactgacctttgccgcagagtctgcgctgccgggtagtccgacgcatatttccaccgatcaccaggggcagtttgtctttgtaggttcttacaatgcgggtaacgtgagcgtaacgcgtctggaagatggcctgccagtgggcgtcgtcgatgtggtcgaggggctggacggttgccattccgccaatatctcaccggacaaccgtacgctgtgggttccggcattaaagcaggatcgcatttgcctgtttacggtcagcgatgatggtcatctcgtggcgcaggaccctgcggaagtgaccaccgttgaaggggccggcccgcgtcatatggtattccatccaaacgaacaatatgcgtattgcgtcaatgagttaaacagctcagtggatgtctgggaactgaaagatccgcacggtaatatcgaatgtgtccagacgctggatatgatgccggaaaacttctccgacacccgttgggcggctgatattcatatcaccccggatggtcgccatttatacgcctgcgaccgtaccgccagcctgattaccgttttcagcgtttcggaagatggcagcgtgttgagtaaagaaggcttccagccaacggaaacccagccgcgcggcttcaatgttgatcacagcggcaagtatctgattgccgccgggcaaaaatctcaccacatctcggtatacgaaattgttggcgagcaggggctactgcatgaaaaaggccgctatgcggtcgggcagggaccaatgtgggtggtggttaacgcacactaaccgctgatttacccggcgcagtctctcctgcgccggtgtattaacctatctcctgtaacgcgtgtctctggcgttcgacgatattggtccacaaattgtctttatcgtcagtccataaattaatcagcaaggcaaaaaagcgttctgctgctggagaaagtacggcatctttacggcgaattattcccaatgttcgacgtataacgggttccaccaatgggataccaataatcgaagaatagggcgcatgaggcattgccaggccaggaagcgccgaaatccccagtcccgcctccaccagtcctaatgacgtcgaaagatgacgcacttcgtaaaaccagtccagcttccagggcttgtcggccagctgttgttctatcaacagtcggttgccgctggaggagcgtacgccaatcattttgtaacccactaactcctgccattctacaagctgctttttggccaatggatggtcacgccgacaggccagcacgaacggctcgttgaccagtggggtaaaatcaatggatgaatttgtgacgttgttcatgtttatgccaaagtctgattcgttacacagcaccgattccatgcaattattcgtgccttgttccagaatccgcactttaatattgggatacagctcattaaatttaccgattgccagcggtaaaaaataaaatactgcggtcggaatacacgctaacgtcaccataccacgatgataagcattcatatcacgaatattaaaaagcgtttcatcgaatttctttattaattcccgcgcctccgggagcaacctttttcctgcttttgttaacgtaaccttgcgagttgtacgctcaaatagttgaacatgtaaatcttcctccatcttttttattcttcgcgttaatgcaggttgcgtaatattgagtaatttagcggcattgttaaacgaactggactctgccagtatgacaaatgccttcatacttgataattcatgcttcattattactccggaaaatggaagcgacgattttgggtggctggccgttaaaaattttaactgcatttagccaacttaaattaatgaaaaaatgttattaatcgttgagctaaagtcattagagatgctttgcccttaatgtaaccatatcgcaataagttatgtttttaaattgagggcattattatgaaaaaaataccctgcgtgatgatgcgaggtggaacctcgaggggcgcgttcctgttagcggaacatttacccgaagatcaaacgcagcgcgataaaatattgatggcaattatgggttccggtaacgatctggaaattgacggtattggcggcggtaatccactgaccagtaaagtcgccattattagccgttccagcgatccgcgtgctgatgtcgattatctgtttgcgcaggtaatcgttcatgagcaacgtgtcgataccacgcctaactgcggcaatatgctgtctggtgttggggcattcgccattgaaaatggtttgattgcagcgacttcgccagttactcgcgtacgtatccgcaacgtcaatacgggtacgttcatcgaagctgatgtgcaaacgccaaatggtgttgtcgagtacgagggtagcgccagaattgacggcgtaccgggtactgccgcaccggttgcgctcactttcctgaatgccgctggaaccaaaaccggaaaagttttcccgactgataatcagattgattattttgacgatgtcccggtgacctgtatcgatatggcgatgccagtcgtcattattccggctgaatatctgggaaaaacaggttatgaattaccggcggaactggatgccgacaaagcattattagcccgcattgaatctatccgtctacaagcgggtaaagcaatgggcttaggtgatgtcagtaatatggttatccctaaacctgtgcttatttctccagcgcagaaaggcggggcaattaatgtgcgttattttatgccgcattcttgccatcgcgcgctggcgataaccggtgctattgctatttccagtagttgtgcattggaaggcaccgtcacccgacaaatcgtcccttctgtaggatacggcaatatcaatattgaacaccccagtggtgcgctcgacgttcatttaagtaatgaaggtcaggatgccacgacgttacgcgcatctgttattcggacgaccagaaaaatattttccggtgaagtttatcttccctgaaaaaattcgttgtcaggataaggacaatcaataaaggacttctgtatgagtcatacagaaagaacaggattttaaatgaataagaaatcgttatggaagctaattctgatattagcgatcccatgtattattggttttatgccagctccggcaggattaagcgaactggcgtgggtgctttttggtatttacctggcggccattgtggggctggttatcaagcctttcccggaacctgtcgtactgttaattgccgttgctgcctcaatggtggtggtcggtaacttatccgacggtgcgtttaaaaccaccgccgtattaagcggttactcttcaggtaccacctggctggtgttctcggcgtttaccttaagcgccgcatttgtgaccaccggtttaggtaaacgtattgcctatctgctgattggtaaaatcggtaacaccacgctgggtctgggttacgttacggtattcctcgatctggtactggctccggcaacaccgtctaacaccgcgcgtgcgggcggcattgtgttaccgatcatcaacagcgtggcggtggctttggggtccgaaccggaaaaaagtccgcgtcgtgtcggacattacctgatgatgtccatttacatggtcaccaaaaccaccagctatatgttctttaccgcaatggcggggaacattctggcgctgaaaatgatcaacgacattctgcacctgcaaattagctggggtggatgggcgctggcagccggattgccgggcatcattatgctgctggtcaccccgctggtgatttacaccatgtatccaccagaaattaagaaggtggataacaaaaccatcgctaaagcgggccttgccgaactaggaccgatgaaaatccgcgaaaaaatgctgctcggtgtctttgtgctggcgctgctgggctggattttcagtaagtctctgggggttgatgaatccaccgtggcaatcgttgttatggcaaccatgctgctgctgggtatcgttacctgggaagacgtggttaaaaataaaggcggctggaataccttaatctggtacggcggtattatcggcttaagctccttattatcgaaagttaaattcttcgaatggttagctgaagtctttaaaaataacctggcatttgatggtcacggtaacgttgctttcttcgttattattttcctcagcattatcgtgcgttatttcttcgcttccggtagtgcctatatcgttgctatgttaccggtatttgccatgctggcgaacgtctccggcgcaccgttaatgttaaccgcgctggcactgttgttctccaactcctatggcggcatggttactcactatggcggcgcggcaggtccggtcatctttggcgtgggttataacgatattaaatcctggtggttggtcggtgcggtactgacgatattaaccttcctggtgcatatcaccctcggcgtgtggtggtggaatatgctgatcggctggaacatgctgtaaatattctcgtcatacttcaagttgcatgtgctgcgtctgcgttcgctcaccccagtcacttacttatgtaagctcctggggattcactcgcttgtcgccttcctgcaactcgaattatttagagtatatccatttattatctttctgcgcacttcacggtgcgcagatatctggagcatttgatgatcaagttatctgaaaaaggcgtgtttctcgccagtaataacgaaataattgccgaagaacatttcaccggcgaaattaaaaaagaagaagccaaaaaaggcactattgcctggtctattctctcttcgcataatacgtccggaaatatggataaacttaaaattaagtttgattcattagcctctcacgatattacctttgttggtattgtacagaccgctaaagcgtccggtatggaacgtttcccgctgccgtatgtgctgaccaactgccataactcactctgcgccgtcggcggcactattaacggtgatgaccatgtttttggtttatcggcggcccagcgttatggcggtatttttgtgcctccgcatattgcggtcatccatcaatatatgcgtgagatgatggcaggcggcggcaaaatgatcctcgggtcagacagccacacccgttacggtgcattagggacaatggcagtcggtgagggcggcggtgagttggtaaaacagctgcttaatgacacctgggatatcgactatccgggcgtggttgcggtgcatctgaccggaaaacctgcgccgtatgtggggccacaggatgtggcgctggctatcattggcgcggtgttcaaaaacggttacgtcaaaaacaaagtcatggagttcgttggaccgggcgttagcgcgctctctaccgatttccgtaacagcgttgacgtgatgaccactgaaacgacctgtttaagttctgtctggcaaaccgatgaagaagtccataactggctggcgctgcacggtcgcggccaggattactgccagcttaaccctcaaccgatggcgtactacgatggctgcatcagcgttgatttaagcgccatcaaaccaatgattgcgctgccgttccacccgagcaacgtgtatgaaatcgacacactgaaccagaacctgaccgacattctgcgtgagattgaaattgagtccgaacgcgtggcgcacggtaaagccaaactctcgctgctggataaagtggaaaatggtcgcctgaaagtgcagcaggggattatcgcgggctgttctggcggtaactacgaaaacgtcatcgcggcggcgaatgcactgcgcggtcaatcctgtggcaatgacaccttctcgctggcagtttacccgtcatcacagccggtgtttatggatctcgccaaaaaaggtgtggtagcagatttgattggcgcaggcgcaatcatcagaaccgcgttctgcggcccatgctttggcgcgggcgatacgccaatcaacaacggtttgagtattcgccacaccacgcgtaacttcccgaaccgcgaaggctctaagccagctaatgggcagatgtcagcggtggcgttgatggacgctcgttctatcgctgcgactgcggcaaacggtggctatttaacctctgccagcgaacttgattgctgggacaacgtgccggagtacgccttcgatgtaacgccgtataaaaaccgtgtttatcagggctttgtgaaaggggcaactcagcaaccgctgatttacgggccgaacattaaagactggccggaattgggtgcgctgactgacaatatcgtcctgaaagtgtgctcgaagatcctcgacgaagtgaccaccaccgacgaactgattccttccggtgaaacctcttcttatcgttcaaatccgattggtctggcggagtttaccctgtctcgccgcgatcccggttatgttagcagaagtaaagcgactgctgagctggaaaatcagcgtctggcggggaatgtcagcgagctgacagaggtgtttgcgcgcattaagcagattgctggtcaggagcatattgatccgctgcaaactgaaattggcagcatggtctatgcggtgaaaccaggcgatggttctgcgcgtgaacaggcggcgagctgccagcgtgtgattggcggtctggcgaatattgccgaggagtacgcgactaaacgctatcgttctaacgtcatcaactgggggatgttaccgctgcaaatggcggaagtaccaacctttgaagtgggggattacatttacatccctggcattaaagcggcgctggataatccgggtacgacgtttaaaggttatgtgatccatgaagatgcgccggtaacggaaattacgctctatatggaaagtctgactgctgaagagcgcgagattatcaaggcgggtagtttgattaacttcaataaaaaccgtcagatgtaaaaagcgccatgtgaatgtaggtcgcattcggcacttattgtcggatgcgatgcttgcgcatcttatccgacctacgaatcgcatcgaatctgtaggccagataaggcattttcgcagcatccggcacttattgtcggatgcgatgcttgcgcatcttatccgacctacaaatcgcatcgaaccgtaggccggataaggcgtttacgccgcatccggcaaatagttaattgctcttacttcttcgcctctgcaaccactttactacccacgccgcggttattgtattcccacatgcggttgtagttagtgtcattcagattgcgctgtatttcgtcgttatcatctacgctgccggtattacccgcaaacggacgattagagatcaccgcatcggcccacggtttagccgtgttaaaaccttcgttgatggcgctatcacggatcaccacctgaccgttggtattggcatcaacatccagcgagcggcccagttgcgccacaccatcaccgaaagcattgaaacggctgtttacggcgaggaaaccgtagtaaatgttggacagcgtagccggtgcaaacacatacgcttcttgctgagtacgtgagttcaccacgcggaattcggtgttatcgaacaccactgcgccgcgaccagaaacgatatccacatccccttcaatgtagctgttggtcaccagcgtacgcggctgacgattcgtttccagacggttctgcacaccgctgttggtgacaaagaaggtgttctgacgaccgagaatgttaacgttgttaatctgtacctggtcaccatcagtacgcagtgccaccgccggatggttacctgcatctacgctatcgcccagcgtgttttcgatggtcagattttgcagttgcaggccattgttttgtgaccagaagaccgcagagcagagaacaccgatactgtcgctgcgtttgctctggcagctatcgtacatataccacgctggtttacctggcatatatttgccgcgcgggttgacgtcgtgacgccagtcggcagggctcatgccaccatcaagggaaagcccaatcttcacatcaatcggtttttcacctgtaccgtacagagtaattccacccggagcggcagggacatataccgttccctgatactcaccaggcatcacggcaatatactggcgcttgttggtacgcttgataattgccgcatctaccgccgcctgaatcgtggtatgcgttacaccttgagtgcccgccgggccgacaacaaagtcaggttgcgcaggcagggtaatcggggaaggattccacgctgcagcacctggtgtcagggatgcaaaatagtgttgagcatcgaaattctgcgcttcttttgccgacagaatcgggcgagaagaggtaccaggcgcggtttgatcagaaggacgttgatcgggcggggttgagctacaggcggtcagcgtcacgccaaaagccaatgccagcgccagacgggaaactgaaaatgtgttcacaggttgctccgggctatgaaatagaaaaatgaatccgttgaagcctgcttttttatactaacttgagcgaaacgggaaggtaaaaagacaaaaagttgtttttaatacctttaagtgataccagatggcattgcgccatctggcagagtgattaactaaacatcgcagtaatcgaggcgcttgccagagagtggaaatgaacgttaaacccgaccatcgcgccgctggcaccttcatcgacatcaatacgttctatatccagcgcgtgaacggtaaaaatgtagcgatgagtttcgcctttcggcggtgctgcgccatcgtacccggttttaccaaagtcggtacgcgtctgcaaaacgccgtctggcattgctaccagaccagagccaaacccttgcggtaatacgcgggtatcagcgggtaagttaacaactacccagtgccaccagccggagccggttggcgcatccgggtcgtagcaggtgacaacaaaacttttcgttcccgcaggaacatcatcccacgccagatgcggtgaaatattatcgccatcgtaacccatgccgttaaagacatgacgatgcggcaatttatcgccatcgcgcagatcgttactgatgagtttcatgaaccctcctttcttgtttgcagaaagtgtagccagaaaccctcacgcggacttctcgttattggcaaaaaaatgtttcatcctgtaccgcgcggttaaccgctgcggtcagacgctgcaactgttgcgggagaataatatagggcggcatcaggtaaatcagtttgccaaaaggccggatccagacaccctgttcgacaaagaatttttgcagcgccgccatattcaccggatgagtggtttcgaccacgccaatggcccccagtacgcgcacatcggcaaccatttcggcatcacgggcgggggcaagttgctcgcgcagctgtacttcaatatccgccacctgttgctgccagtcgccagattcgagaatcgccaggctggcgtttgctgccgcgcaggccagcggattgcccataaaagttggcccatgcataaagcaaccggcttcaccgttactgatggtttctgcaacctcgcgcgtggtgagtgtggcggaaagggtcattgtgccgccggttaaggctttaccgaggcacaaaatgtccggcgcgatttctgcatgttcacaggcaaacagtttcccggtacgaccaaatccagtggcgatctcgtcggcaatcagcaagataccttcgcgatcgcatattttgcggattcgttttaaccattccggatggtacatgcgcatcccgcctgcgccctggacaatcggctcaatgatcaccgccgcgatttcatgacgatgcgccgccatcaggcgggcaaagcccaccatatcgcgctcatcccattcgccatccatgcggctttgcggggcgggagcaaacaggttttctggcaggtagcctttccacagactgtgcattgagttatccggatcgcacaccgacatcgcgccaaaggtatcgccatgataaccattgcggaaggtcagaaaacgctggcgcgcttcgcctttggcttgccagtactgcaacgccattttcatcgccacttccaccgctacggaaccggagtccgcgagaaaaacgcactccagcggttgcggcgtcatcgccaccagtttgcggcacagctcaatggctggcgcatgggtgataccgccaaacatcacatgcgacatggcatcaatttgcgacttcatcgccgcattaagctgcgggtgattgtagccgtggatcgccgcccaccaggacgacataccgtcaaccaggcgtctgccgtcagacaaaatcagctcgcaaccttcggcgctcaccaccggataaaccggcagaggggaggtcatggatgtgtatgggtgccagatatggcgttggtcaaaggcaagatcgtccgttgtcataatcgacttgtaaaccaaattgaaaagatttaggtttacaagtctacaccgaattaacaacaaaaaacacgttttggagaagccccatggctcaccgcccacgctggacattgtcgcaagtcacagaattatttgaaaaaccgttgctggatctgctgtttgaagcgcagcaggtgcatcgccagcatttcgatcctcgtcaggtgcaggtcagcacgttgctgtcgattaagaccggagcttgtccggaagattgcaaatactgcccgcaaagctcgcgctacaaaaccgggctggaagccgagcggttgatggaagttgaacaggtgctggagtcggcgcgcaaagcgaaagcggcaggatcgacgcgcttctgtatgggcgcggcgtggaagaatccccacgaacgcgatatgccgtacctggaacaaatggtgcagggggtaaaagcgatggggctggaggcgtgtatgacgctgggcacgttgagtgaatctcaggcgcagcgcctcgcgaacgccgggctggattactacaaccacaacctggacacctcgccggagttttacggcaatatcatcaccacacgcacttatcaggaacgcctcgatacgctggaaaaagtgcgcgatgccgggatcaaagtctgttctggcggcattgtgggcttaggcgaaacggtaaaagatcgcgccggattattgctgcaactggcaaacctgccgacgccgccggaaagcgtgccaatcaacatgctggtgaaggtgaaaggcacgccgcttgccgataacgatgatgtcgatgcctttgattttattcgcaccattgcggtcgcgcggatcatgatgccaacctcttacgtgcgcctttctgccggacgcgagcagatgaacgaacagactcaggcgatgtgctttatggcaggcgcaaactcgattttctacggttgcaaactgctgaccacgccgaatccggaagaagataaagacctgcaactgttccgcaaactggggctaaatccgcagcaaactgccgtgctggcaggggataacgaacaacagcaacgtcttgaacaggcgctgatgaccccggacaccgacgaatattacaacgcggcagcattatgagctggcaggagaaaatcaacgcggcgctcgatgcgcggcgtgctgccgatgccctgcgtcgccgttatccggtggcgcaaggagccggacgctggctggtggcggatgatcgccagtatctgaacttttccagtaacgattatttaggtttaagccatcatccgcaaattatccgtgcctggcagcagggggcggagcaatttggcatcggtagcggcggctccggtcacgtcagcggttatagcgtggtgcatcaggcactggaagaagagctggccgagtggcttggctattcgcgggcactgctgtttatctctggtttcgccgctaatcaggcagttattgccgcgatgatggcgaaagaggaccgtattgctgccgaccggcttagccatgcctcattgctggaagctgccagtttaagcccgtcgcagcttcgccgttttgctcataacgatgtcactcatttggcgcgattgcttgcttccccctgtccggggcagcaaatggtggtgacagaaggcgtgttcagcatggacggcgatagtgcgccactggcggaaatccagcaggtaacgcaacagcacaatggctggttgatggtcgatgatgcccacggcacgggcgttatcggggagcaggggcgcggcagctgctggctgcaaaaggtaaaaccagaattgctggtagtgacttttggcaaaggatttggcgtcagcggggcagcggtgctttgctccagtacggtggcggattatctgctgcaattcgcccgccaccttatctacagcaccagtatgccgcccgctcaggcgcaggcattacgtgcgtcgctggcggtcattcgcagtgatgagggtgatgcacggcgcgaaaaactggcggcactcattacgcgttttcgtgccggagtacaggatttgccgtttacgcttgctgattcatgcagcgccatccagccattgattgtcggtgataacagccgtgcgttacaactggcagaaaaactgcgtcagcaaggctgctgggtcacggcgattcgcccgccaaccgtacccgctggtactgcgcgactgcgcttaacgctaaccgctgcgcatgaaatgcaggatatcgaccgtctgctggaggtgctgcatggcaacggttaataaacaagccattgcagcggcatttggtcgggcagccgcacactatgagcaacatgcagatctacagcgccagagtgctgacgccttactggcaatgcttccacagcgtaaatacacccacgtactggacgcgggttgtggacctggctggatgagccgccactggcgggaacgtcacgcgcaggtgacggccttagatctctcgccgccaatgcttgttcaggcacgccagaaggatgccgcagaccattatctggcgggagatatcgaatccctgccgttagcgactgcgacgttcgatcttgcatggagcaatctcgcagtgcagtggtgcggtaatttatccacggcactccgcgagctgtatcgggtggtgcgccccaaaggcgtggtcgcgtttaccacgctggtgcagggatcgttacccgaactgcatcaggcgtggcaggcggtggacgagcgtccgcatgctaatcgctttttaccgccagatgaaatcgaacagtcgctgaacggcgtgcattatcaacatcatattcagcccatcacgctgtggtttgatgatgcgctcagtgccatgcgttcgctgaaaggcatcggtgccacgcatcttcatgaagggcgcgacccgcgaatattaacgcgttcgcagttgcagcgattgcaactggcctggccgcaacagcaggggcgatatcctctgacgtatcatctttttttgggagtgattgctcgtgagtaaacgttattttgtcaccggaacggataccgaagtggggaaaactgtcgccagttgtgcacttttacaagccgcaaaggcagcaggctaccggacggcaggttataaaccggtcgcctctggcagcgaaaagaccccggaaggtttacgcaatagcgacgcgctggcgttacagcgcaacagcagcctgcagctggattacgcaacagtaaatccttacaccttcgcagaacccacttcgccgcacatcatcagcgcgcaagagggcagaccgatagaatcattggtaatgagcgccggattacgcgcgcttgaacaacaggctgactgggtgttagtggaaggtgctggcggctggtttacgccgctttctgacactttcacttttgcagattgggtaacacaggaacaactgccggtgatactggtagttggtgtgaaactcggctgtattaatcacgcgatgttgactgcacaggtaatacaacacgccggactgactctggcgggttgggtggcgaacgatgttacgcctccgggaaaacgtcacgctgaatatatgaccacgctcacccgcatgattcccgcgccgctgctgggagagatcccctggcttgcagaaaatccagaaaatgcggcaaccggaaagtacataaaccttgccttgttgtagccattctgtatttggttaaattgcgagcgagatcgcgtcttcgattgactgcaatttaaccaattaaattctaaaataatcacgaaaaaaattttacttccgcctcatgcggcgaatgtgggaattgcccaggcggcgggggataggggctggagacagttatccactattcctgtggataaccatgtgtattagagttagaaaacacgaggcaagcgagagaatacgcggcttgcacgcgaattggcgttaaagacggctcaaagaaatatcttttattttttaactggttagataaatgcaatggcagtcactgaacaggcatctcttgccataaaactgtcatcactcatcttgacaaatgttaaaaaagccgttgctttggggataacccggtaaggccggagttttatctcgccacagagtaaattttgctcatgattgacagcggagtttacgctgtatcagaaatattatggtgatgaactgtttttttatccagtataatttgttggcataattaagtacgacgagtaaaattacatacctgcccgcccaactccttcaggtagcgactcatgagtaaaccgttcaaactgaattccgcttttaaaccttctggcgatcagccagaggcgattcgacgtctcgaagaggggctggaagatggcctggcgcaccagacgttacttggcgtgactggctcagggaaaaccttcaccattgccaatgtcattgctgaccttcagcgcccaaccatggtacttgcgcccaacaaaacgctggcggcccagctgtatggcgaaatgaaagagttcttcccggaaaacgcggtggaatatttcgtttcctactacgactactatcagccggaagcctatgtaccgagttccgacactttcattgagaaagatgcctcggttaacgaacatattgagcagatgcgtttgtccgccaccaaagcgatgctggagcggcgtgatgtggttgtggtggcgtctgtttccgcgatttatggtctgggcgatcctgatttatatctcaagatgatgctccatctcacggtcggtatgattatcgatcagcgcgcgattctgcgccgactggcggagctgcaatacgctcgtaatgatcaagcattccagcgtggtactttccgcgttcgtggcgaggtgatagatatcttcccggcagaatcggatgacattgcacttcgcgtggaactgtttgacgaggaagtggaacgattgtcgttatttgacccgctgaccgggcagattgtttccactattccacgttttaccatctacccgaaaacgcactacgtcacaccgcgcgagcgcatcgtacaggcgatggaggagatcaaagaagagctggccgccagacgcaaagtgctgttggaaaacaacaaactgctggaagagcagcggctgacccagcgtacccagtttgatctggagatgatgaacgagctgggctactgttcggggattgaaaactactcgcgcttcctctccggtcgtggaccgggtgagccaccgccgacgctgtttgattacctgcctgccgatgggctgctggtcgtcgatgaatctcacgtcaccattccacaaattggcggcatgtatcgcggtgaccgggcgcgtaaagagacactggtggagtacggcttccgcctgccatcagcgctggataaccgtccgcttaagtttgaagagttcgaagcattagcgccgcaaaccatctatgtttcggcgacgccgggtaattacgagctggaaaaatccggcggcgatgtggtggatcaggtggtgcgtccaaccggattgcttgacccgattatcgaagtgcggccggtggcgacacaggttgatgatcttctttcggagattcgtcagcgagcggcaattaacgaacgcgtactggtcaccacactgaccaagcggatggcggaagatcttaccgaatatctcgaagaacatggcgagcgcgtgcgttatcttcactcagatatcgacaccgtcgaacgtatggagattatccgcgacttgcgtctgggtgagttcgacgtgctggtagggatcaacttactgcgcgaaggtctggatatgccggaagtgtcgctggtggcgatcctcgacgctgacaaagaaggcttcctgcgttccgaacgttcgttgatccagaccattggtcgtgcggcacgtaacgttaacggtaaagcgattctctacggcgataagatcaccccatcaatggcgaaagcgattggcgaaaccgaacgtcgccgtgagaaacagcagaagtacaacgaggaacacggaattacgccgcaaggcttgaacaagaaagtggtcgatatcctggcgctggggcagaacattgccaaaaccaaagcgaagggcagaggaaaatcgcgcccgattgttgagccggataatgtgccgatggatatgtcgcctaaagcgttgcagcagaaaatccatgagctggaagggttgatgatgcaacacgcgcagaatctggagttcgaagaagcggcgcaaattcgtgaccagttgcatcagctgcgtgagctgtttatcgcggcatcgtaacaggatagcgaagaagactgatgacaaacggaaaacagcctgatgcgctacgcttatcaggcctacattttctccgcaatatattgaatttgcgcggtttgtaggccggataaggcgttcacgccgcatccggcataaacaacgcgcactttgtcttcaataggaagccggaattttccttcggatttccgttaacctaaagcctgtaacgccttttccagcgcgttatgtaacaactggcggtcatgacgatacggaatatcgctggcctccagtacctcctggatcacaatccgctctttcaccgccgagacatccacttttggcccgacgatgaccgcatcaatgacctttttaccaacatactgctccataattgccagcttgctttccagcttcaaattagccgcaggtaaactcaactcacgccccagattgccgatataaaccatcggcgctggcgtgcggcgtaatgcctgggcgatttccttcagcagcagaattggcatcaggctggtataaaaactgccaggcccaataatgatgagatccgcttcattgatagcgtgaaccgcctcacgcgttgcgggtacattaggcgttaacaataactcttgaatcggcgtagttaactggtcgatattgacctcgccgtaaacttcatgcccctgatcgtcaatcgccatcagatcaacaggatgctctgacattggaatcaaatgcgtatccactttcagcagattacgaattaaattgatggcttccagaggccgcacgctaaggtgatccagcgcctttaacatcaagtttccgagattatgaccggaaagttcgccattgccaccaaaacggtattcaaacatcgcggaggcgacgctcggttccgttatcagctggttgaggcagttgcgcatatcgccccaggcaatgccgccttctgaacggcgaatacgccccgtcgagccaccattatcggtggtggtgacgatacccgttaaacgagaacccaaagacgaaagtgatgagagaacgcgtcccagtccatgccctccgccgagagcaacgacacgatcaagatcagccagcgtacgattgcgcatatagtttcctggagtcagattatccgcgctacagtagcgcaaattgcggggaaacagcaattaacctgccaatattgaggatacaaactattttcttctacctctaaaggacgatgcacgctatgcctccctgatgatgtatatcaaagtaaaaccgccattttcccttattctgtagcgaaatagcacgatcatgacgctatatacatgattacatagcgaaagtgtggatggtaaaaatctcatttacacgctagtatcggcataaccactaaacactctagcctctgcacctgggtcaactgatacggtgctttggccgtgacaatgctcgtaaagattgccaccagggcgaaggaagaaatgacttcgcctcccgtatctggaaaggtgtacatggcttcacaactgactgatgcatttgcgcgtaagttttactacttgcgcctgtcgattaccgatgtgtgtaactttcgttgcacctactgcctgccggatggctacaaaccgagcggcgtcaccaataaaggctttcttaccgtcgatgaaattcgccgggttacgcgcgccttcgccagactgggcaccgaaaaagtgcgcctgacaggaggagagccgtctttacgccgcgactttaccgatatcatcgccgctgtgcgggaaaacgacgctatccgccagattgcggtcacaaccaatggttaccgtctggaacgcgatgtggcgagctggcgcgatgcgggacttactggcattaacgtcagtgtcgacagtctggacgcccgccagtttcacgctattaccgggcaggataaattcaaccaggtcatggcagggattgatgctgcatttgaggccggttttgagaaggtcaaagtcaataccgtgctgatgcgtgatgttaatcatcaccagctcgacacctttctgaactggatccagcatcgccctatccagctgcgtttcatcgaactgatggaaacgggcgagggcagcgagctcttccgtaagcatcacatctctggtcaggttctgcgtgacgagctactgcgtcgcggctggatccaccaattacgtcaacgcagcgacggtcccgcgcaagtcttttgccatccagattacgccggagagattggccttatcatgccgtatgaaaaagacttctgcgccacttgcaaccgcctgcgcgtttcctccattggtaaactccatctctgcctgtttggtgaaggcggcgttaacctgcgcgatctgctggaagacgatacccagcaacaggcgctggaagcgcgtatttcagcggcgctgcgggagaagaaacagacccatttcctgcatcaaaacaacaccggtattacgcaaaacttatcgtacattggcggctaaaacgtcaaaaggagagatcagatgagtcaggtaagcactgaatttatcccgacccgtattgctattcttacggtttctaatcgtcgcggtgaagaagacgatacctccggtcactatctgcgcgattcggcgcaagaagcgggccatcacgttgtcgataaagccattgtgaaagaaaaccgctacgctattcgcgctcaggtatctgcgtggatcgccagcgacgatgtacaagtggtattgattacgggtggtactggcctgacggaaggtgatcaggctcccgaagcattgctgccgttgttcgaccgtgaagttgaaggttttggtgaagtgttccggatgttgtcgtttgaagagattggcacttccacgttgcaatctcgtgcggtagcgggcgtcgccaacaaaacgctgattttcgccatgccgggttcgaccaaagcgtgccgtaccgcatgggaaaatatcatcgcgccgcagctggatgcccgtacgcgtccgtgtaatttccatccacatttgaagaaataagtatgtcgcaactgacccatatcaacgccgctggcgaagcgcacatggtggatgtctccgccaaagcggaaaccgtgcgtgaagcgcgggcggaagcctttgtcaccatgcgcagcgagacgctggcgatgattattgatggtcgccaccacaaaggcgacgtatttgccactgcgcgtattgccggtattcaggcggcaaaacgcacctgggatctgatcccgctctgtcatccgctgatgctcagcaaagttgaagtcaatttacaggccgagccggagcacaatcgggtgcgtatagaaaccttatgccgcctgaccgggaaaaccggtgtcgaaatggaagcattaaccgcggcctccgtggcggcgctgaccatttatgacatgtgcaaagcggtgcaaaaagatatggtgattggtccggtacgtttgctggcgaagagcggcggcaagtcgggtgactttaaggtggaagcggatgattaaagttctttttttcgcccaggtgcgcgagttggtgggaacagatgcaaccgaagtggctgcggatttcccaactgttgaagcgttacgccagcacatggctgcgcagagcgatcgctgggcgctggcgctggaagatggcaaattactggctgccgtcaaccagacgctggtgagttttgaccatccgctgactgacggcgacgaagtagctttcttcccgccggtaaccggaggttaagatggcagaaaccaaaattgttgttggtccgcagccgttcagcgtaggagaagagtacccgtggctggcggagcgtgacgaagacggtgcggtagtcacctttactggtaaggtgcgcaaccataacctgggcgacagcgtcaacgcattaaccctcgaacactatccggggatgactgaaaaagcactggcagaaattgttgatgaagcgcgtaaccgctggccgctggggcgcgtcactgtgattcaccgcatcggggaattatggccgggcgatgaaatcgtttttgtcggtgtcaccagtgcgcatcgcagcagtgcgtttgaagccgggcagtttattatggattatctcaaaacccgcgcaccgttctggaagcgcgaagccacgccggaaggcgaccgctgggttgaagctcgggagagcgatcagcaggcggcaaaacgctggtagttttttgttagccggataaggcaccgctgcgtccggcaatttcaccgctcagtacatacgtttacgctgcgtcgatgcacagcctcatcattttgcagtatccttaagatattccttatatcttcaggagatcgtcatggacagattcccacgttctgattcaatcgtacaaccccgggctggcttgcaaacttatatggctcaagtctatggctggatgaccgttggcttgttgctgaccgcatttgttgcctggtatgcggctaattccgcggccgtgatggagctgttgttcactaaccgtgtctttttaatcggtctgatcatcgcgcaattagcattggttattgtgttatcagcgatgattcaaaagctgagcgcaggtgtaacgacgatgctctttatgctttattcggcgctgacgggtcttacgctttccagtatattcattgtctataccgctgcttctatcgccagtactttcgtcgttactgccgggatgttcggcgcaatgagcctgtacggttacaccacgaagcgcgatttaagtggctttggcaatatgctgtttatggcgttaatcggcattgtgctggcatcgctggtcaacttctggttgaaaagcgaagcattgatgtgggcagttacctacatcggcgtgattgtctttgtcggattgacggcgtatgacacgcagaaactgaaaaatatgggtgagcagattgatacccgcgacacgtcgaacctgcgcaaatattccattcttggcgcgttaaccttgtatctggacttcatcaacctgttcctgatgttgttgcggatcttcggcaaccgccgttaattctttttcaccatcactatcccggccatgtgtcgggatttttttcttactaaaaacgacacttaacaagtaccaggtataaaatatgccttatggacgagcggaagcgttttctgtatccataaatgcaaaagtattttgtatgcgtggttttaaatttattgatggtgaatattaatattttttctaaggataactaaaagaatggaatcatactcgcaaaacagcaataaattagattttcagcacgaggccaggatattaaacggtatatggctcattaccgctttaggtttggtggcaaccgcaggactagcctggggagctaagtatatcgaaattacggcaaccaaatatgattcaccaccaatgtatgtcgccatagggttattattactttgtatgtatggcttaagtaaggatatcaacaagataaatgccgccatcgcgggcgtaatatatctgtttttactctctttggtggcgattgtcgttgcaagtttagttcctgtatatgccattatcatcgtgttcagcactgcgggcgcgatgtttttaatcagtatgctggccggtttattatttaatgttgatcctggttctcaccgttttatcattatgatgacgttgacagggttggccctggtaatcatcgtgaatgcggcattaatgagtgaacggcccatttggataataagttgcttaatgattgtgttatggtcaggcattatctcgcatggacgaaataagctccttgaattggcggggaaatgccatagtgaagagttgtggagtccggttcgttgcgcttttacaggtgcattaacactctattactattttatcggcttctttgggatacttgccgcgatagctataacgcttgtctggcaaaggcatacgcgtttttttcattagccgtaaatgcacatactaaagaacttaactaaacttcacatcgccgcttcatttttcgcccgtagcttcttcgcctggctttccagcaacaggtaacagatcagcgccagcagcagtgggataaagtaatacagcacacggtaagcgagtagggcggcgataattgtacctttggaggtatgctccccagccagtagtgcgataaacaccgcttccagcacaccgatccccgccggaatatgcacgatgacgccagcaatactactaaccagtaacacgcccagtacaaagaaatagttcacgctttgaccaagtaacagccagataatcgcccccattaccatccagttaacgctggaaatcagcatctgagcgagggcgaatttccatgaaggcagcaccagcttttgccctttgatggtcatatggcggtgcttcgcgaaagcgcaaaaccacaaataaaccgcgataatcatcagtaagccaatgccgagaatacgcagcgtagtttgatcgacataccagtgatccggcaactccaccacgcctgcggtaaagataatccctgccagtaaaatgtagcccagccagttggtggtaatactgagcgagaaaatccgcgtaatagtgctaccgggcaaccccagacgagagtacaaacgatagcgcataccaatgccgccgacccaggtactgagcgtcaggttgaaggcgtagcagataaacgacaccagcatcacctggcgcttcgccagtttgtgaccgcagtaaaagcgggcgagcaggtcatagcagccgtaaatcagatagctgacgaccaccagcccgaccgcactaagcagcgcaacgcgattgtagtcgcggatgaccttccagacctcttcccagtccacttttttggcgtagaccaccagcaacacaatcaccgcgataaaaaacagccaggtgaggatcttctttgctaagcgccagcgcgggtgtgatttactcatcagggttttacccccgtgttttcagtttctacccgatcctgcgtttccattgtcggttgtgcgggcggatcaacctgcgccagacgtggcgtgtgtgccggaagccagccaaccagcgccgggaagtggcgtaaaaagtggaacgccagcacgcttttggtcaggttccaccaggtgcgtttgggcagcatggtttcatccacctgctgacaatctgcggcaataatgccgttcagattatcgcgcagcgtctggttaaaatgacgatcgtggatgatgacatttgcttcgagattcagtgacaaactgagcggatcgagattactggaccctactgtcgcccagtgatcgtccatcaatgccactttgccgtggagcgggcggcggcggtactcaaaaacctgaacgccgcctttaaccagatagttatacagcaagcgcgcaccgactctgacaatcggcatatccggttcgccctgaatgatcagtttgatccgcaccccgcgccgtgccgctttacgcaaggcgtgtaaaaatcgatagccggggaagaagtaggcgttggcgataatcacttcccgccgcgcctgagtgagcattttcaaataatggcgttcaatatcatcgcgatgttcttcgttatcgcgccagaccagcaatacctgcgcttctcccggctggcggttctcttccgctttgtgatgacgtcgccaccagcgtcgtgccgcgctctgtccaggcaggttttccagctcaaactggagaatatcttcgacaatcggcccttcaaggcgtaccgcgtaatcctgtttagcctctggaccgtagctggacatatgctcggcggagtaattcagcccgccaataaaggctatacgcgcgtcgatcaccacaattttgcgatgcatccggcgaaacacattggtgcgcataccaaaaaggcgagggcggggatcgtagtagcggaacactacgccagctgccgtcagttcattgacaaactcatcgctgagatccggcgaaccgtagccatccagcaagacttccgctttaaccccgcgttgcgctgctgccagtagtgccgcatgcagttgtttgccgacgtcatcctcaaaccagataaacgtttcaagaatgatgcgttcttgtgcctcgccaatcgccttaaacaccgcgggataatattgctcgccgttttccagcaactggatcttattgccttcgcgccagctacatttcataaatgaatctccgcacttaaaggggcatgatcagaaaggtgtcgccatgtccgcagcggcaacgcggttggcgcgctggcgctggcatttttgacgtagatcctgtccagtcgtagtagaggaaattgcaccggaaacgtgcgcgccgggcgtccgtgggcgcgggtaaaaatctcatccagtccggcctgcacttttaacggatgattagctttttgccgccagtcattgaaatcacccgccaccaataccggttcgccgtccggtagctcattcacccattcggcgagcatcgcaagctgcgcctgacggtgcgcctcacgcaggcccagatgtacgcacatcacatgaatcgcttttccggtcatcggcggcacaatgcggcagtagagcacgccgcgcttttccgcaccatcgaccgaaacatcgcgattctcataatgttcaatgggataacgcgacagtacggcgttgccgtgatgcccttccgggtatacggcattgcgaccgtaggcaaaatcgctccacatagtgtcggcgagaaactcgtagtgcgaggtatcgggccagttttccacatgcagcggatgaacttcgtgcgcgcccatcacttcctgcaggcaaacaatatcggcgctgacggtacgcacggcgtcgcgaagttccggcaaaatgaagcgtcggttaaacgcggtaaagcctttgtgaatattgatggtgagcaccttgaacgaaaattgttgtgtttgatcgggcataattttcctgtctttgcctcttatctcattgaaatagtgtagtcggcgtcacaaaaaggtgcggtcttacggaattttccgtaaagttcggtactctgagtaagtagagataaattcttcaggagagaagccatgaagtggcaacaacgtgttcgtgtcgcaacgggtctaagttgctggcagattatgttgcatttactggtagtggcgctgctggtggtgggctggatgagtaagactctggttcacgtcggcgtgggattatgcgcactgtattgtgtcacggtagtgatgatgctggtgtttcagcgccaccccgagcaacgctggcgtgaggtggcagacgtgctggaagagctgaccacgacctggtattttggcgcagcgctgattgtgctgtggctgttgtcccgcgttctggaaaacaactttttgctggcaattgcagggctggcaatccttgccggcccggcggtagtgtctttgctggcgaaagataagaagttacatcaccttacgtctaaacatcgcgtacgccgctgaccctgtcgtggccgttatcaccagtagcggccacaaactattccacacaatatccagactcgcatccttcaaataaatctgcttggtaatgtccgtaaagtggcgaatagggttaatccacgtcaggttttgcagccataccggcatgttttccaccggagaaacgtaaccggaaaggagaatggcgggcatcataaagacaaacacgccgataaacgcctgctgttgtgttgaacagagtgatgaaatcaacagaccgaatcccaccagcgataaaccataaatcaccatcgtaaagtagaacagcgccagcgatccggcgaaggggatttgatacgcccagataccaatcgccagcacaatggtggcctggaaggtggcgacaattaacgccggtacggctttgccgatgaagatctgccaggtggtgagcggcgaaaccagtagctgatcgagcgtaccttgttcacgttcgcgggcgacggaaagtgaagtgacgatcattacgccgatagtggtgatcatggcgatcagtgacggcaccacaaaccatttgtagtcgagattcgggttataccagttgcgtaccaccagctcgctgttgttaggtttcggttttccttccagcagctcctgctgataatttttgacgatctgttgcaggtagttggcggcaatttgcgcactgttggagttacgcccgtcgaggatcaactgcaaaggcgcggtctggaaggtatccagtttgcgcgagaagtcagccgggaaacgcaccagtagtaacgccttttgtgtgtcgatggttgggcggatctcctgtgggcttttcagcagcagcacatgagtaaaggcgctggcgcgggcaaaacgttgggtcagctccaccgaatgctcgccgttatcttcatcgtagatggcgatggtggcgttagtcacttccagcgtggcggcgaacgggaacaggatcacctgaattagcacgggtaaaatcagaatcgcgcgggtttgcggttcgcgcagcaacgactgcaactctttgcggattaacgtccataagcgatgaaacatgctcttctccctaatccagccgacgtttggttttcagccacgtcaggccgataaacatcaccgccgaagcgatcaaaaacagcacgtttaccaccagcaccactggaatattcccggcgaggaacaggctttgcagggtgctgacgaaataacgagcgggaataatgtacgtcaccgcgcggatcaccgcgggcatactgtcgatctgaaaaataaagccggaaagcataatcgacggcagaaaagcggcgttcagggcgacctgagcggcattgaactggttgcgggtaatcgtggaaatcagcagccccatccccagggtactgagtaaaaacaggctggagataaaaaacagaatcagcagcgacccgcgatacggcacgccgagaataaacactgacaccagcatacacagcaacatcgccagcatcccgagaaagtaataagggatcagcttacacagcagcagttccgtgcgggtaatctccgtagagagcagagcctccatggtgccgcgttcccattctcgcgccaccaccagcgaggtgagaatcgcgccgatgaccgtcatgataatggtcaccgcaccggggataatgaagtgctggctaatcgccgccgggttaaaccagtagcgggtttgtacatcaataagcggttcaaaagtctgcccgttgtcctccgctcgctgcatttgccagatctgccagatcccttcgacatacccctgtacaaagttagcggtattcggctcactgccgtcggtgatcacctgaatcggtgcggtggcgttggcgcgctccatctgttccgcaaaatccaccggaataaccaccagaccgcgaattttccccgcctgcattttggcgatcagttcctgacggttatcgctgatggtggcgtcgatgtagggcgaaccggtcatggtgtgggtgaaatccagcgccgcttcgctacgctgttccagtaaaatcccgacccgcagcttgctggagtcgaggttaatgccgtaaccaaaaataaacagcagtagcagcgggatcactaccgcaatcagccagctactcggatcgcgaacgatctgccgcgtctctttaacgcacagcgcccgtacgcgacgccaggacaggatcgggttactcattgctatgctccttatcccagtcgtggatcaactgaataaaggcttgctccatggtgggatcgggttgctcatcgttagccgactgtgctttcaaatcgtccggcgtgccgctggcgattaatttcccgcggtacaccaggccgatgcggtcgcaatattccgcttcatccataaagtgggtggtgaccatcaccgtgacgcctttctctaccatgctgttgatgtgcagccaaaattcacggcgggtgagggggtcaacgccggaagtcggttcgtcgagaaacagaatgtccggttcatgcatcagcgaacaggccagcgccagccgctgtttaaaacctaatggcagttcatcggtggcgtgggaggcgatacttttcaggccgaacgcctcgctcatgcgggagattttttcgttctgcgcccgaccgcgtaagccatacacaccagagaaaaagcgtaaattctgttcgaccgtcaggttaccgtagagcgaaaatttttgcgccatatagccgagatgctggcgcgctttaccggaactctctttcagatccatccccagcaccagcgcctggccggaagtcggcaccagcaaaccgcacatcatcttaaaggtggtcgatttacccgcgccgtttggccccagcaaaccaaaaatctccccacgtttaacggcaaagttgacgtgatcggtggcggcaaaatccccaaatttcttggtcagttctttcgcttcgatcaccgtctcgccgggtgtgccttctaccgtatgtaatattgcgcccagcggcgattccgaggttccggcaccgcccagcaaatcaataaacgcatcttcaaaacgcggcgtagtttcgttgatgttgatttccggcatcccgtcggcatggcgaatatcgtctggtgtggcctcttttttgaggatcagacgtaccgatttcccctgaatcatgccgtcgctgacctgcggcagtttcaaggcgcgttgcaacagtttgcggttgccctcgtgtggactggtcatcagaaagctgcgtccggccatggtttgtgtcagggcttttggttctccctgatacagcaactcgccttcgttcatcagtaacacgtcacggcactgctcggcttcgtcgagatacgaggtactccagaggattaacatcccttcgcccgccagctcatgcaccatctgccacagttcgcgccgtgagatagggtcaacgccgacgccgggttcatcgagcagcaacactttcggttcgcccaccagggtacaggccagaccgagtttttgtttcatcccaccggagagcttgcccgccaggcgtccggtaaacggcccaagagacgtaaactccagcaggcgagcaaaagtttgcttacgtgcctcgccggtgacgctgcgcaaatccgcgtacagattgaggttctccatcaccgtgagatcttcatacagaccaaatttctgcggcatataaccgagcacggcgtgcagcgcgccgtcgtttttgatcggatcaaagccaatcaccgtggcactgccgctgtcgggtttcagtaatcccgccaacatccgcatcagcgtggttttacctgcaccgtccggccccaccaaccccgtcacataaccggcgtgaatggtacaatcgagcggcgcgacggcgggcttgtccatgcccggaaagcgtttttccaggccgttcagcgtgataacggcatcattcatgtcctgcctcgtcaccgaattgtaccgtcactggcattccctggcgtaacgcatcatcggcgtcggtcaccacaatacgcaggcgatagacgaggtcggtacgcagatccggcgtttcgacggttttcggggtaaattcagcagtcggcgaaacgaaaccaatctgcccgtgatacggcttgtccgggcgaccatcggtataaagcagcactttgcgccccggctgggcctggtcaagattacgttcatcaacataagcgcgcacccacaccggacgcgttagtgaaacggtaaacaccgtgccaccttcattgaggaccgtgcctggctccaccgcgcgcgttaacagcgtgccatcagacggggctatcaacgttgagtcctgtaaattcaactccgcctgcgccagttgcgcctgcgcctgttcgaggctggctttcgcctgagcgatgtcctgttcacggttaccggaacggtactgacgcaatttatcctgtgctgatttcagcgttgcctgcgcctggtcgcgcgaggagcgggcattttccaggtcatttgccgaaatagtgcggcttttccacaacccttgctggcggttatagaagttctgcgcatagtcataggcggcttgcgcctgtttcaccgctgcggcggcctgagcgatttcttcattgcgatacccggcaagcatcaggtcatactgcgcctgtgccaccgaaacacccgctttcgcctgcatcagggcaatctcatacggcttgtgatccagttcgcccagcacctggcccgctttgatagcatcaccttcgtccaccgccagcgattcaacgcgccccccaacacggaaactaagatttaccgtacgaatatccacgttgccatacagcgtcaggccgttatcctggcggctttgataccaccagtagcctccggcaaccacggcggcaagtaccactaccgccaatccgatcacgacaggttttttcatcactacaaactcctttgcgataatccttgcaaaatcaggtcgatatgacaggtcaccgtctggttgatcagttcggtcttttcttcatcgaacgcggtccagccggtacgtaacagaattgtttctttgccaagacggaacgccagaatctcaccaatcaacgcatgggtatgaaggatcatgcgggtgtcattggcgtcgcagccggtccaggcggcaatcaggcgtgtcaggtggctgtgtagcggactaatcacctgttcgtgcaccaggtggtaggctgccgtgggagagagctgctcacgggagataaacttgctgaggttgacggtgtcatcctgggtgagcagcttaatcatgttcctgcaggcgcgaaggatcagttcacggatggcagcccgatcaggctgtggttgcgcgaacaagcgttcggcttcctcggcatgcggacggaactgctcgccaataaaatcggcaatccactgggcgcaggcgaggtacaaatcttctttcgaaccgaagtagtaggtgatggcagcgatattctgcccggcctgggcggctatctcgcgagtggtggcgttcattccatattcaccaaactgcgccagtgcggcagcaatcagctgttttttcgcctgttcacccttgattgtcatggcaggattattcatcgcacagtccattcttaatcaaatgattgattaagattatgactccataggggagttgtccagtatggctaagaattttagcaacgccagtcacagggataatttatgcgctgcgtcacaaaaactgctacactccgctccctcatgacattgtggtttttgtcattttccttttcagtatctccctgaaaactacaccggtaacggtcggggcggttcggagtagttatgtctttcgattctttgggtttaagccctgatatcctgcgcgccgttgccgagcagggttaccgtgaacccacccctattcagcagcaggcgatccctgcggtgctggaaggccgcgacctgatggctagcgcccagaccggcaccggcaaaacagcgggctttacgctgccgctgttgcaacacctgatcactcgccagccgcacgccaaagggcgtcgtccggtacgtgcgctcattcttaccccgacccgtgaactggcggcgcagattggcgaaaacgtccgtgattacagcaaatacctgaacattcgttcgctggtggtgtttggtggtgtgagtattaacccgcagatgatgaaactgcgtggcggcgttgatgtgctggtggcaaccccgggacgtttgctggacctggaacatcagaatgcagtgaagctggatcaggttgaaatcctcgtcctcgatgaagctgaccgcatgctcgacatgggctttatccacgatatccgtcgcgtgttaacaaaactacctgcgaagcgccagaacctgttattctccgcgaccttctctgacgatattaaagccctggcggaaaaactgttgcacaacccgctggaaatcgaagtggcacgccgcaataccgcgtctgatcaggtgacccagcacgttcactttgtcgataagaaacgcaaacgcgaattgctgtcgcacatgattgggaaagggaactggcagcaggtgctggtgtttacccgtaccaaacacggcgctaaccatctggctgaacagctcaataaagatggcatccgtagtgcggcgatccacggcaataaatcgcaaggtgcgcgtactcgtgcgctggctgattttaaatcgggcgatattcgtgtactggtggcaactgacatcgctgcgcgcggcctggatattgaagagctgccgcacgtcgtcaactatgaactgccaaacgtacctgaagattatgtccaccgtatcgggcgtaccggtcgtgcggctgctaccggtgaagcgttgtcgctggtgtgtgttgatgaacacaaactgctgcgtgatatcgaaaaactgctgaaaaaagagatcccgcgcattgcgattccgggctatgagccggacccgtcaatcaaagccgaaccgatccagaacggtcgccagcaacgtggcggcggcggtcgtgggcaaggtggtggtcgcggtcaacagcaaccacgccgtggggaaggtggcgcaaaatctgcaagcgcgaaacctgcagaaaaaccgtctcgccgcctcggcgatgccaaaccggcaggcgaacaacaacgtcgccgccgtccgcgtaaacctgccgctgcgcagtaatcttttatgccgggctatgcccggcatcaggctgatgaacaaacgcaaaactgcctgatgcgctacgcttatcaggcctacgtgaactctgcaatatattgaatttgcatgcttttgtaggccggataaggcgtttacgccgcatccggcatttcacaacaagcacttgtcagcaatttgagaacacgggaaaaaatttatctgttttaccgcccataagccaccgagacgttacttctctatagccaattgttcgcgcaactccattaaaaggtagcccagtcgattcttgcccttaccatgaccaccgtctccccagtaagcatcgttttccgtatgctcaaccagttttgcgggcgcggttgccagcaagagcgcacgcagttctgcatgctgttcgaatttagcgcgaagtgcttttcgcatcacctgttctttgaccgactcccagtttttacgcagaggcttagaacgatcgcgccccatgcgtgcggcgaccataggggaagaaacccgacggatctcttcgcggtatttttcatcaaggaatttttgtgcctgaaaatagtgttctgaggtaggccaggttttcccgtcaaccttgatgggccaggcggcaaagttagaaaaatcaccgtagtcatcgctggtgctgtagaaatttatgatggtgtcttgcatgacgtgttggatcctttgtgctcgaacgggcattaaaccgcattatgttggtggttattgcgagccgctttccagaaacagaaaaaccattacccctgaaaaccgaaaaatgccacaatattggctgtttatacagtatttcaggttttctcatggcattaaccgccgcgcttaaagcgcaaattgccgcctggtataaggcgcttcaggaacagatccccgactttattccccgtgcgccgcagcggcagatgattgcggacgtcgccaaaacgctggccggagaagaagggcgacatctggcgattgaagcccccaccggcgttgggaaaacgctctcttatttgattcccggcatcgccattgcccgcgaagagcaaaaaacgctggtggtgagtaccgccaacgtggcattgcaggatcagatttacagcaaagatttaccgctgctgaaaaagatcattcccgatcttaaattcactgccgcttttgggcgtgggcgctacgtttgtccgcgtaatctgacggcgctcgccagtactgaacccacgcaacaggatctgctggcgtttcttgacgacgaactgacgccgaacaatcaggaagagcaaaaacgttgtgcgaagctgaagggcgatctcgatacttataaatgggatggtctgcgcgatcatactgatatcgctatagatgacgatctctggcgtcgtttaagtaccgacaaagccagctgcctcaaccgcaattgttactactatcgtgaatgcccgttttttgtcgctcgtcgggagattcaggaagcggaagtggtggtggcaaaccatgcgctggtgatggcggcgatggaaagcgaagcggtattgcctgacccgaaaaatttactgctggtgctggacgaaggccatcacctgccggatgtggcgcgggatgcgcttgagatgagcgccgaaatcaccgcgccgtggtatcggctacagctggacttgttcacgaaactggtcgctacctgcatggagcagtttcgcccgaagaccatcccaccgctggcgatccctgaacgtttgaatgcgcattgtgaagagttgtatgagcttatcgcctcgttaaacaacattctcaatctctacatgcctgccgggcaggaggcagagcaccgttttgcgatgggcgaactgccagatgaagtgctggagatctgccagcggctggcaaaactcaccgagatgctgcgtggcctggcggagttatttcttaacgatttaagtgagaaaaccggcagccatgacattgtacgtctgcatcggttgattttgcagatgaaccgcgcgttggggatgttcgaggcgcaaagcaaactctggcggctggcttcgctggcgcaatcttccggtgcaccggtgaccaaatgggcgacgcgggaagagcgcgaagggcagctacacctctggtttcactgcgtgggaatacgtgtcagcgatcagctggaaaggctgctgtggcgcagtattccgcacattattgtcacctccgcaaccttgcgttcgctgaacagtttttcgcgtttgcaggagatgagtggtctgaaagagaaagcgggcgaccgttttgtggcgctggattccccctttaaccactgcgaacagggcaaaattgttattccccggatgcgcgttgagccttccatcgacaacgaagagcagcatattgccgaaatggcggcctttttccgtaagcaggtggagagcaaaaaacatctcggtatgttggtactgtttgccagcggacgggcgatgcagcgctttctcgactatgtgacggatttacgtctgatgttgctggttcagggcgatcagccgcgttaccgtttagttgaactgcaccgcaaacgcgtcgccaacggtgagcgcagcgtgctggtgggcttacagtcatttgccgaagggcttgatttgaaaggtgatctgctcagccaggtgcatatccacaaaatcgcttttccgcccatcgacagcccggtggtgatcaccgaaggggaatggctgaaaagcctcaaccgctatccgtttgaggtgcaaagcctgccgagcgcctcgtttaacctgattcagcaggttgggcgactgattcgaagccacggttgctggggcgaagtggttatctacgacaaacgcttgctgaccaaaaattatggcaagcgactactggatgcattaccggtatttccgatagagcaaccggaagtccctgaaggtatagttaaaaagaaagaaaaaacgaaatccccacgccgtcggcggcgttaatgatgtgagtcaggtaaggagtcgtaaatggactatcgcaaaatcattaaagagatcgggcgcgggaaaaaccacgcgcgcgatttagaccgggatactgcgcgcggtctgtatgctcatatgctcaatggtgaagtccctgaccttgagttgggcggcgtattgattgcgctgcgtatcaaaggagaaggggaagcagagatgctcggcttttacgaagccatgcaaaatcacaccatcaagctgacgccgccagcaggcaagccgatgccgattgtcatccccagttacaacggcgcgcgtaaacaggccaacctgacgccgttgttggcgattctcctgcacaaactcggttttcctgtggtggttcacggggttagcgaagatccaacccgcgtgctgactgaaaccatttttgaattgatgggtattacgccaacgttgcacggcgggcaggcgcaggcgaagctcgacgaacatcaaccggtgtttatgccagtcggcgcgttttgcccgccgctggaaaaacaactggcgatgcgctggcggatgggcgtgcgtaacagtgcacataccctggcgaaactggcgacgccatttgccgaaggtgaggcgctgcgtctttccagcgtttcgcatccggaatacattggacgcgtcgcgaagttctttagcgatatcggcgggcgggcgctactaatgcatggtactgaaggtgaagtgtatgctaatccgcagcgctgcccgcagatcaatctcattgaccgtgaagggatgcgggtgctgtatgaaaaacaggacactgctggtagcgagttactgccacaagcaaaagatccggaaaccacggcgcagtggattgagcgttgccttgctggcagcgaaccgattcccgaatcgctgaaaatccagatggcttgctgcctggtggctacgggtgaagcggcaactatcagcgacggcctggcgcgcgttaatcaggcattttaattcttttctcagccggatgagccatgtcatccggcttttaccccaccgcaatatgaaattcctgcatctttattgaccttcccacgcccggcgtgcagcataaaaatacaacaaacacataacataaacaggagttaaccatggaaagtggtcatcgctttgatgctcagacgctgcacagttttattcaggctgtatttcgtcagatgggtagcgaggaacaagaagcgaaattagttgccgatcatttaatcgcggcaaacctggcagggcatgattcacatggtattggcatgatcccaagctatgtacgctcctggagtcaggggcacctgcaaattaaccatcatgccaaaaccgttaaagaggcgggggcggcggtcacgctcgatggcgatcgcgcatttggtcaggtcgcggcacatgaagcgatggcgctggggattgagaaagcgcatcagcacggtattgccgccgtggcgctacataactcgcatcatatcggccgtatcggttactgggcggagcagtgtgcagcggcggggtttgtctctatccactttgttagcgtggtcggtattccaatggtcgcgccgttccacggtcgcgacagccgctttggcaccaatccgttctgtgtggttttccctcgtaaagataatttcccgctgttgcttgattacgccaccagcgccattgcatttggcaaaacccgcgtcgcctggcataaaggcgtccccgtgccgccaggttgcctgattgacgttaacggcgtgccgacgaccaatccggcggtaatgcaggagtcgccgttgggttcgctgttgacctttgccgaacataaaggctacgcccttgcagcgatgtgtgaaattcttggcggggcgctttccggcggtaaaacgacgcatcaggaaacgttacaaaccagtcccgatgccattcttaactgcatgaccactatcatcatcaacccggaactcttcggcgcgccggattgtaacgcgcagaccgaagcctttgccgagtgggtgaaagcctcgccgcatgatgatgataagccgattttgctaccgggcgagtgggaagtgaacacgcgtcgcgaacggcagaagcaggggattccactggatgcgggaagctggcaggccatttgtgatgcagcgcggcagattggtatgccggaagagacgttgcaggctttctgtcagcagttagccagctaaaaaaaagcccgtccagtggcggacgggcaaacaagggtaacataggatcaatgagggttagagcatatgcgtctgtcggcaaacagacagggaaatacttgtgctggacgtagcgtaaacgcctgatccgtccaacggttcggattttgtaggcctgataagacgcggtagcgtcgcatcaggcatctgttgccggatgcggcgtaaacgccttatccgtcctacgaattacttataaattaccgcagtaccgcttaatttattgttgttggtggcggaagtgatgctgtatccactggcaccggctgccgcggctttctcagccagtttcgcttccagggcatcgagggtggatgcgccatcggcagaaaccacgccgattttattcatgttctgtgcctgggatgccgttaccggttccgccgcgaacacgccaaatgacagagttgaaagagccatagcagcaacaacagtattgatagttttcataattaatctctcgcaggtgatttttgtataagtgacgttgtttcgtcgatgtgatgagtatcacgtttttttacgagagataaaatcgaagagaattgaccgccttgttcaaataaattgattgatatctaacctactgataaaccatttatttgttgtacttatgaacttgttttataccgcgtggcagtcacagcagcgttaaaggcacggaatgacacgcaaaatacaaattatactcgctatgcatctcgccagttgtagttaacgtaactggctgtctttcgaacctctgcgattatatcctgtataagctggtttttgtaaatctttctcctgctgacaatgaatacataagcgcacgccaggaatggcttcccgacgggcctgcgggatgggggcaccgcactcttcacattcatccaggctttcgccgcgcggaatttcaccccgagcgcgggcaatcgcatcttcaattgtactgttgatctgttcgttgacggcgtcatcgttagcccaaccggatgccatatcgacctccccatatcaatacttgtacagttaagtgtagctaatccagggacgaactcgggcagttcaagcatcagatctccgaccattcccgcagcagattatgataaagattaagcagcgacaggatctcttcactttcgccgtagcggcttttcagcgactgaatattgttgtccagttcaaacagcatggcgcgctttttatcatcgcggatcatcgactggatccacataaatgatgccactcgtacgccgcgggttacgggtgtcacgcaatgcaggctgctggagggatacaacacgagatcgcctgccgggagttttacccgatgttgtccgaaggtgtcattaacgaccagttcgccgccgtcgtagctttgtggatcgcttaaaaacagcgtggcagaaaggtcagtacgcatccagccgttttgtggatggctgcgtactgcgccatccacatggaaaccataggtttcattgttctgatagcgattaaacagcggcgtggaaagggtacgcggcaaggccgcggcaaagaataaagcatgttggttaaccgcgttcagcacctcattttgcagggcggcgtataacgtgctgcgggtgtcgacctgttgattgttcttaacttgcgcaccttgtgcgccggtggtgacgcgtccatccacccattcggcttgttccagttgttcgcgaaaacgagcgacgtcctgtggcgataacacgccgggaatgtggtacatcatacaatttctccaaaaagtggggcctgcgccccacatctgaatcagaaatgcatattggctgtgagcaagaaggttcttggctcgcccgggtgataacggtagccgctcttgttgattgaggcgacgtaatcggtatcaaacaggttgtaaacgtttagctggaagtcgagattgcgattaactcgataccccagtttggcatcggcgacccagtaaccttcggtaaacgctggcgttcccaccgcgccgtctgaacctttatgcatactgccgatatagcgtgcgcccgcgccaacagagatatcgtcggttgcctgatattggctccataaggtgaaggcgtgctccggggtatacggcagcgatgaggaaccatcctgggcaacatctttgccgtttttgatggttgctttttgctgggtatagccgccaatcacctgccacgcgggagtgatattcccggccacggatatctcatagccttcgacgcgtttcttaccgtattgcgagtaagttccgtcatcattttgctcaacttcattttcgatatcagtgcggaacagcgcggcggtgagcaacagacgtttatccagaacctgccatttggtgccaatctcgctggtgttggctttttgcggtttaaaatcggtgcggttggcactgttaccgctgccagactgcgcaagggcgaagttgttgccgcccggaggctgctgggaaacggcatagttaatatagacattgccgttttccgtcaggtgatacagcgccccggctttccagttcatcagattgcccgacttggcggtgtcgacggtggtgaccggagaaccttttgccacaccagttgggcaggtgatggcaccgcgtccgctgccgccgcaggcggtggcactgtcatattcagtatgataattatccagacggatcccgccgttcagctcaaaatcacgggtgatttgcagcgtatcaaaggcgtaaattgcgaaggtatccgtctgaccattggcgtttgcgccgttgcgcgtcaggccgccgggatgaatgctgctgtcaggatgataaatatttaccgcgggtaacgtcaccggattaacgccgtagttagtctgcgtttcacgggtaaattccacgccggtactgacatcatgaccgatagaaccggtatagaacgtcgaggtcaggttggtctggttggtgagaattttattactcacatctttggtattcgccgtgcgtgaccaggtccagctattcacatcgctggtgggctgagtaatattcgacgccccgcccataatcgccgtcatcaggtaatcctgctttacgcgcgaccaacgggtagtattgcgaatggtggtgttatcgttgatgtcgtgctcaaaacgcatggtggcggtgtcggtggtcgaatcgtcgtaatcggaatccgtgccgtaaaagttatgagtatcaacttttccggaatgattcagggccgccgttcccgcagatggggcagaatagcccggcaaaccgatggtcggaatgccgccgtctggcgtgttgtgctgggtgacatgcagataattaagatacaaacgattcgctgtaccaaggccaaaagcgacagaaggggcgacgccgtaacgctcatttttgactttgtcgcgtccggcatcgtgcgttttttcgcccattacattcaggcgcaccgcggtggtatcaccaatgacctgattgacgtccagcgtgccgcggcggaaccaggcgctgccaatactggcggaggcgtcaatgccggaatcattgcgcggctgcttgctgatcatattgatcgagcctgtcggtgcgctgcgcccgtagtcggtgccggacggccctttaatcacttcgacctgctcggtattgaaggtgtcgcgcgagacgctgccgatatcgcgaatgccatcaatataaatactgttagaggtatcggcaccacgcatataaatggcgtcgccagtggtggagttaccgttctcacccgcaaaaaacgcacccacgccggggacgtttttgagcgcgtcggtaaggttggttgcgccctgatctttaatcacttgttcagaaattaccgtcatcgtgcgggtagtatccgctaccggacgcgagaatttcggatcggcagattgttgtggcgcataaagcgaaggcgttgatgcttcgacaaccagcgtgtcatccgcgttagtttgcccttcggcggcgagtgcctgagccacaggcgtgatgccaatacaaagaccggcaaagaacgtgagcgaatgaaattgtctggcagggaaattgcgattgttttccattttgcaggtgactttttcttatatgttgaaattttcactgccacgagaaagcctctctgcggatgcgatgccactgttaatcccgtgatagtgctcgtgaaagtgataataattttgataagcattatcacttggagcgattttctatcacccattgcgcgaaaaagaaatacatttatttacattgagttcatatttgatgttttttgattacaaaacagacgaaaactgcatccagaggcgaatgcagttacgttggtggggttatttgtagatggttgcagtaccgaacatctggtcatttccgcctgcggaattaatgacataacctttcgcgccttgttcgcgcgctttttctgccagtttatcctccagatcgcttaggtttgatgcgccagttgccgaaacggtaccggcgggccgtagctgaccgctgtccaggttactcatcggttgcgcggcataagccgtgagagagattccgctcaggacggtggcaatcagtagtgtgaggcactttttcataatgacatcctcataaatacaacgggtagtgcctgataagtgtaggtcgcctgcgcgatgcaaatgacgcaaaaaattgacagagatgtgcttattttttgaacgatatatttttacaaaataagacaaatcaatgacatgcataatgctgatttttatgatgaattgccataaaccatagccatgttaaggttttggggaatgataaacgcagccagatatttaccctgtcgcgttatgcgggtatcttacgccgctgcttaaaggagaatgctatgtccgcccagaaaccggggttgcatccgcgcaaccgtcatcacagccgctacgatctcgccacgctttgtcaggtcaatcctgaactcaggcaattcctcacgcttacacccgccggggagcaaagcgtagactttgccaatccgctggcggtgaaggcgctcaataaggcgttgctggcccatttttacgccgtagcgaactgggatatccccgacggttttctctgcccaccagtaccgggccgggcggattatattcatcaccttgccgatttactggcagaagcaagcggaacaattccagcgaatgccagcattctggatatcggcgttggtgcgaactgtatttatccgctgattggcgtacatgaatatggctggcgttttaccggtagtgaaaccagcagccaggcgttaagcagtgcgcaggcgattatcagttctaatccggggcttaaccgcgccattcgtctgcgtcggcaaaaagagagtggggcgatttttaacggcatcatccataaaaacgagcaatacgacgcgaccttgtgtaacccgccattccacgattccgccgctgcggcacgggcaggtagtgagcgtaaacgccgtaacctggggctgaacaaagacgatgcactgaactttggcggccagcaacaggagttgtggtgtgaaggcggtgaagtcacctttatcaaaaagatgattgaagagagcaaaggcttcgcgaagcaggtgatgtggtttacatcactggtatctcgtggtgaaaacttaccgccgttgtatcgtgccctgacggacgtgggcgcggtgaaggtggttaaaaaagagatggcccaggggcaaaagcagagtcgctttattgcctggacctttatgaacgacgagcagcgccgccgttttgtcaatcgccagcgttaaagcgttggttcccccggcggtaacggttcagccggggtcgcgcccggagcaggcagcacctgataagtctgcactggcgcgcgaacgcccgccaggtcgaaatgttttttcacctggctgtcgagggcaaagcgtaccgtccactgtttgagtggcagcgtggtgaacgaaacacgcagtgtaaacgcggtattgcttaagccgacaatcccggcaaaattcggttcaccaataatcagcccgcgaatttcttcgttttccattaattccgctaccgcatctttcagtgcctgattggctttatcagcatcttcatggcgatcaacatcataatttgccaccaccgaaccaatgccgcggacaaagttagcaaaggtggttatcgaagaccacggaatgatgtgatacgccccggtatcctgtcgtacgcccacggagcgaatcgacatccgttccactgtgccggtcaacggcccgatagtcaccaaatctccagtgttcatgccgttttcaaactgaataaataccccggtgataatatctttcaccagcgtttgcgaaccaaacgagatagccagacctaatgccccggcacctgccagcaatggcgcgatattgacgccgatttccgacaacacaatcatgatggtgatggtactgataatcaccgccagcgcgttacgaaacagcgtaagcagggtacgcgtgcgggcgctgggtagcgggcggccatgaatatccgaagccagccggttttcgatcaaactggcgagcaccgtccagccaaccgccgagaagaaaagaatgagtgcgatacggatcaggatatctacggttttctgccccgcgccgttttgcagccagttccagaaatcgaacaatccccatgcgctcaacagcaacattaccgccacgcagactgtcagaatacgcgccgttttcagcgccgccgacagccagccattcaaccgtttttgcagctccggatagttacgctgagtatgtggcgagagagtgatggttttcgccagccagcgggaaaacataccggaaacaaacgctgcgataccaataatcgccaggctgcgcaccgttgcacccatcataaatttcaggctgttgcccggatcgaacaacgaaaagaaaaacagcacgataaaataggcgcttgccagccagtgccacaccagcgcaaaggcgcggataaacaggctgaaaaaggccagcgaatgctccgcgaagttgagcaaatgctgggtaatctcttttttattacgaaagatcaggtacaacgcccagacggtcatgcacagcataatgatgacgttcgccagcgcacctatctgtacattcacctgattagagataatcggcacggccacaatcaggccataacctatcaaactgcttaaccagctcaggcgacgactccagtaacgggcgctctcgtcctgaatcgtgaacgggcgcagctccgccacgtttgggcaaaaaatcaggcgtagtacggctttgaaaaattcaatgagggcaaaggcgttgagaaacaaactttgttggaaagcgatggtgcgactgcctgcattcaggttgtcgcttaatacctggccgacaaataatgtcagggccagtaacagcaggtcgataataaacgccccgataatcatcgccggaagctgcaaccagttgctgcgctcacgatttttttgccgcgcccactgacccattttgcgatacagcggcagtgcgcacaggcgaatcagccagtaaaaaccaaacactaataccgctaacattgaaaaatgggtcagcgcattgctgaaggtttgtggattaaacggcttatgcggggagccggtgatattgcgataaagttgcccgaagcgggcggaaagggcttcaccataatggcggctgacttcggtgaccttttgcagcacggtttgctcttcgaccagcgtcggcggcactatttttggtaccggttcagcagggggcgtagcggcaacggtgcgcaactggtcgatcaactctttacgcgaggtgtcattatccagcacatccgccagtgcgccataggccgcttttttttgttcgatatccggttccggggccggttcagtcgttgagtccgttgtcgttgtggttgtaacgccgggtatggataccgcgtgggcaggtgcgcccagcaggcagaagaggatgaacaggatccaccgcatgactcctccagtgagaaaatagagcaaaaagataagtatagatgctggaggaggggcgattttaaatgagaggaatctggtgtgcctccctttcgggtgaaagggaggaagggatattaagcaggttgctgacaacgtgcgggcttttttgccggatgcggcgtgaacgccttatccgtcctacaagttcatgcaattttaataagttgccagatatcctgtaggcctgataagcgtagcgcatcaggcaatgtgtcttattaagagacgtgctgcaaaaattcctgcaagcgctggctcggcgggttcttgatcaacacctgcggattgccatcttccgcaatccggcctttgtcgataaagatcagccgcgaagctactttctcggcaaaaccgatttcgtgggtcacgatcaccatcgtcatcccttcttcagccagatcctgcataaccttcagcacttcatggcgcagttccgggtcaagagcggaagtcggttcatcaaacagcatcattttcggcttcaccgccagcgcgcgggcaatcgccacacgctgctgttgaccaccagaaagttcggaagggtagtgatgtgcacgttctgccagaccgactttcgccagcagctcacgtgccagtttttccgcctcttctttgttcgcgccacgcacgcgtagcgggccaaacatgacgttttccagcgctgtcagatgcgggaagaggtaaaactgctggaacaccatacctgcttcctggcgaatcaggcgctcgtcaactttcggatcgttaaccttcaggccatcgacaatcagatcgccggaggtgatttcttccagtttgttgatgcagcgcagcagggtcgatttaccggaaccggacggcccgataatcaccacgacttcgccctgggcaatgttcaaatcgatattgtgcagcacctgggttgggccaaagtgcttggagacgtttttaaattcaatcacaggattttcatccttctttccagacgacgcagaataaagctcagcaccagggtaataatcagatagaacaccgccacggcgctccagatctcaagggcgcggaagttaccggcaataatttcttgcccctgacgggtcagttccgccacgccgatcacaataaacagcgaggtgtctttaatgctgatgatccactggttacccagcggcggcagcatacgacgcagtgccagcggtaaaatgacgtagcgaatggtttcccaacgtgaaagaccgagcgccagtcctgcttcacgaaaacctttgtggatagacagcaccgcaccacgcgtgatttccgcaatatacgcgccggagttgatcatgatggtgaccaccgccgcagtaaatgggtcgatgcgtaagtcgttaaacgccatcggcagggcgaaataaataaacatcacctggacgacgataggtgtgccgcggatcacttcaataaagaccagcgcgacgtggttggctatccaacctccgaaggtgcgtgcaaaacctgccagcaatccgattaccagaccgcctgccagaccgaggaccgaaatccacagggtcattttggcaccttcaatcagaagcggaatggcaggccagatggcactccagtcaaactgcatatgttgttcctgttaccgtggtgtaaataatcaaattcagggtaattaatggccccggagcgggtttgcgcccctcaccctaatcctctccccataggggagagggaactgccagtgcgttttacaggtgtagcgttattatttcggttcagtaccgaaccattttttgtagatttcgttgtaagttccgttctcgcgcagggttttcaacgcgccgttgactttgtcacgcagctcgtcgctacctttcgggaacgcaataccgtattgctgcgcttccagagagtcacctaccgctttgaactgaccgttaccggcggttttgatgaagtacagaatgtttggcgtatcgtgcagaacggcgtctgcgcggttggtgcccagttccatataggcgttatcgatgttcgggaactgacgcagatctttagttttgatgtttgctttcgcgtaatcaacggagccagtaccgctcttcacagcaaccactttcccgtcgagatctttcacgcttttcacatcgttattgttagctttcaccatcactaacaggccgcttttgtagtagccgtcagagaaatcgatcgcttttttacgctcgtcggtgatggtaatgcccgccagcgccagatcgacgtttttggtttgcagtgccggaatgatcccactgaaatccatcggcttcagttcgtaatccagcttcagctctttagcgatggcagcccacagatcaacgtcaaagcccacatatttatcgccctgtttaaattcaaacggaacgaaggcggtatccgtcgcgacaactaattttttatccgcggcatgagaagaaaccgcaaaagccagggtcagtgcagccagtgaaacttttaatacagacttcatagcatttccttttttctatccacgggacgatcccctgcgtgacattcacatatatgaaaaaatcgtgccagttttgcaactccttgatttttcgagatgcggcaaaaacgtgatgcacgatttatagggcaataccctgaagatgcaccattctggggcaccaatctggtgcgctaaaattgtgcactcaacacagtgattatttagcgtaaaacctgatgaaaaaacaatctttatgtaacgattgtgtgatgatgtggatacaaaaaatttacttaatcagctggagatagcagatggatgcactaaataagtgcgttgaggtgggctgcaaaacaaaacggcctcctgtcaggaagccgcttttatcgggtactaaagttctgcaccatcagcgatggatttattcgatgttagactcgataaaccacaggaatttatccaggtcgcgagacgcggcggtcaggatatctgcggtgtcgtcatctttcgcttcgccaatcgctttgcgtacgtcattagcgacgattgcgtaacggtcagccagttctttcaggtgatcctgaacgttgtggatgtccagcgggtaacttttcagcggggttttgctgttgataacttgagtggtccccagagctacaccgcccagctgcactgcacgttctgccatggtatccagatgatcgatcagtgcggtgcggaagccatccagcatttcatgtacggcaatgaagttagcgccgcgcatgttccagtgcgcttgtttggtaatcaaagaaagatcaataaactggataacctggcgattcagcaactctactgttgcttttttctcgctgtcggagacatcgttgcgggtataaagcagattggtcgcttttgatttaactaatttagcggtactcataatttcatatcctcttgatgttatgtcccagtaattaacgagattaagtatagcaccggctatgtgttccgctattctggctgttcctatcacactaatagtggtaacaagcgtgaaaaacaaaactaataaagattcaatgagttagatatattgataagaacaattcttatttatctgctcgccaggaattttcggaataaatatgcttttgcataattcgatatataaagacggtgtagaggaaaagtagcgagaaattctgcatggttatgcataaccatgcagaaatgtaaatttaattaatgtctaattcttttattttgctctctttgcgtactgtcagcgtagaccccattgaagcggcgatgatagcgccgagcgccagtagctgtatgggtgtcagtgtttctccgaggaaaatcatcccggaaacggcagccagcgccggttccatgctcatcagcgtaccaaatgtccgtgttggcaaacgggtgagggcaatcatttccagcgaataaggcagagcggtcgagagaatagcgacagccagacccaatggaataaccgaccagtgccagagtgcttcaccagcctgaagcgctccaattggcacgaaaattaacgctgcaatcaacgaaccaattgccaccgtcgcagggccatgttccgctcctgcgcgttgcccacttaaaatgtaaatagcccaacaagccccggcccccagtgccagcgcacagccggttaaatcgacatgggaaacgtcttgccccagcggtagcaggaaccacagaccaagaaccgccagcacaacccagacgaaatctaccgggcgacgagaagagaacagcgccaccgccagtggtccggtgaactccagcgccaccgcaatacccagcggtactgtctgaatagaaagataaaaaagataattcatcccacccagcgaaacgccgtaaaacaacagcggtaaccgttgctctttggcaaagcgcagtcgccatggcttaaagaacgcgatgaggatcagcgttcctaatgccagacgcagcgcagtgacacccggtgcgcccaccagaggaaaaagtgacttagctaacgaggctccaccctgaatagacgccatggcaacgagcaatatgactattggtaaccagaccggcattttacgtaatgaaccaggcatcctttctcccacaaatatctagacttaagtaaagcgtggagtgtactggatatacccaatgctggttgagcatttgttgaaaaaattttcccccgttttgactaaaatgcgccaggattgatggaatcattagtctggtgattaggaataatctggatgaatgacagggaaaacatgcgtaatacttacgcagttctctgaaaaagtgatttaaatttagatggatagcggtgtatggaaacgttctgttacatgaaatggcccgttagacatcacaaatcgcgaagagtttcccattaatttttgatatatttaaaacttaggacttatttgaatcacatttgaggtggttatgaaaaaaattgcatgtctttcagcactggccgcagttctggctttcaccgcaggtacttccgtagctgcgacttctactgtaactggcggttacgcacagagcgacgctcagggccaaatgaacaaaatgggcggtttcaacctgaaataccgctatgaagaagacaacagcccgctgggtgtgatcggttctttcacttacaccgagaaaagccgtactgcaagctctggtgactacaacaaaaaccagtactacggcatcactgctggtccggcttaccgcattaacgactgggcaagcatctacggtgtagtgggtgtgggttatggtaaattccagaccactgaatacccgacctacaaacacgacaccagcgactacggtttctcctacggtgcgggtctgcagttcaacccgatggaaaacgttgctctggacttctcttacgagcagagccgtattcgtagcgttgacgtaggcacctggattgccggtgttggttaccgcttctaatcactttggtgatataaaaaatccgcctctcggggcggatttttgtttttaaggtttcgggtcgaaaatatcggttccgagatggttgtaatccaccttctgtaactggaagttggtgatgtatatcggcccggctttcttctcagatataaacgggtatttgatgttaatttccttcgctttaatccccgtccactgggagaaaaagcctaagaagtcattggctgagcggcgggctttaatcacacgatgcgctttatcgtcgctggaaatgaccataaaaggcacctggaaattttgctgatatttatcatcatgggcaaggtattgcacgtctttaccgcgctctttaaaggccagaccgtggtcagaaaagtaaaccagcgagaagctgctgccgctgttgcgtaactgatcgtacagcttgcgcagtaaatcgtccgtttgcgtcatggtatagagatagcacgacgtttctttcgattgcacaaaggtttcgtattttccttgtgtcctgtcgcaggcctgcggatgtgagcccatcagatgtagaacaatcagctgcggttgcgagtgctcttgcgccagcacttgagcggtcatatccagtaacgcttcgtctttggtgtttttatctgcttcaaaattaccttctttcaggaagtacacttcatctgctcgtttggcgatgctggcgatagcggtatcgtattcgccgatttgaccctggttggaaaaccaccaggtctggaagcccgcgcgatttgccagggtgacaaagttatcctgaaactgtggtttgccatcgacaacgcgattgagcgttaagccaagcgatttctgcgtggagccactggcggcaatgtagtcagcaaatatcaaaccgttaacgctgctggcaaacggggtattgtcccagtgaccgccaaaggcaccgagggcatcgcgacgcgcgctttcaccgatcaccaccacataggtctgatacttcggcttaacggcagtgaccgtccaggtatctttcattccggaaagttttgccatccgttcttgctcttcaatcacctcgttattattgacgatgacatccttagcaaaacgaaataccggatagccagtatctttcagtttaaatacgccaccccaggccaggttttgcacgggagcaacaaaaaatgtcgccacactgaataccagacacaggctgtcgaaggtattccagcgcgctttttcattctctttttttcgcctgattgctattacgccgagcgcaaaaataaataagccgaccaggtagctgtaccacggaaaaatcgtcaggatttcggtcgactcttccatattggtggagtgcaatgccagcaatgtattgaaattaggcgcgccgtaggcctgagcaaaagggaaataacaagccgccaccagcgaactgacaccgaccagaactttttgtacgcgaggcaatgttcgccatagcaaaagcaaaatagccgtaaacgcagcggtgtagagcaaactgaaggggtaacctaagccgaggttaattaatagcgactgtaaaaagtagaacgcagtccacgggctaaatacccggctacgggtaacaagcgattctttgagggttaaattcatatgccactatcgtaacaaacgccatgtgcttaccctggcgtcaagggtcaatacctgcaagagtgcgtgaagagtggaaaggggtccgcatccgcgagccgcaatatacgcagggctgcaagaagatagagcgagccgccgttcaggtcaactactgacgaacaaatcttttgcgaaggggattgcaaatccgacaaaaagtggggtttttcagaccaaaacgcgttatgcctgcatgaaagcaggagtgaagcggcgtaccgcgacgccgctatttatcggaaggtttatcttgctgcggtttgttgttgaccatatcgcacaacatagagagcagcattaaccgtactttaaagggagaatgactaaacacgcgcatacacctcttgaactcattcataagacctcctgacttgctaatcccgtcgatccttgagggatgattgcattacatacagatatagcacaggctatattatatagctattgctaaaacgttaattttttgtaccttcgcaactctggtttacaatgtgcgcacgaaatgagaacgctatgtatgcgtcaccataatgaggaagcacaatgagtcgtcgcgcaggtacgccaacagcaaaaaaagtgacgcagttagtgaacgtggaagagcacgttgaagggttccgccaggtcagagaggcgcatcggcgcgagcttattgatgattacgttgagctgatttctgacttgatcagggaagtgggggaagctcgtcaggtggacatggctgctcgtctgggagtttcgcaaccgacggtggctaaaatgcttaagcggctggcaaccatggggctgattgaaatgatcccctggcgtggcgtgtttttaacggcagaaggagagaagctggcgcaggaaagccgcgagcgacatcagatagtcgaaaatttcttgttggtgttgggcgtcagtccggaaatcgcccgtcgcgacgcggaaggcatggagcaccatgttagtgaagagacgctcgacgcttttcgtttgtttacccagaaacacggtgccaaatgagcctgccttttttacgcacgctgcaaggcgatcgtttttttcagttattaattcttgttggtatcggattaagctttttcgtgccctttgcaccgaaatcctggcctgctgctatcgactggcacaccatcatcaccttaagcggcctgatgctgctgaccaaaggtgtggagttaagcggttattttgatgtgctggggcgcaaaatggtgcgccgctttgctacggagcgtcggctggcgatgtttatggtgctggcggcggcgctgctttctacctttctgaccaacgatgtcgcgctgtttattgttgttccgctgactatcacgctaaaaagactgtgtgagatcccggttaatcggctgattatttttgaggcgctggcagtcaacgctggttcgctactgacgccaattggcaacccgcaaaatattcttatctggggacgttctggtctttcgtttgccggatttattgcccaaatggcaccgctggctggcgcaatgatgctgacgctcctgctcctgtgctggtgttgtttccctggaaaggcgatgcaataccatacgggggtgcaaacaccggagtggaaaccgcggctggtgtggagttgtctggggctgtatatcgtctttctgacggcgctggagttcaaacaagagctgtggggactggtgattgtggcggcaggctttgcgctgctggcacgtcgcgtggtgctcagtgtggactggacgctgctgctggtgtttatggcgatgtttatcgacgtccatttactgacccagcttccagcgttgcaaggcgtgttgggtaacgtgagtcatctatctgaacccgggttatggttaacggcaatcggtttatcgcaggtgatcagtaacgtgccgagtaccatattgttgctgaactatgtgccgccgtctttattactggtatgggcggtaaacgtaggtggctttgggttattacccggatcgctggcaaatttgattgcgctacgtatggcgaacgatcgccgcatctggtggcgtttccatctctattcaataccgatgctgttgtgggcggcgttggtgggatatgttttgttagttatactcccggccaactagggtctggcaaataaaaaaggcggattatgagtccgccttttgctttaagttttgaagattaattcagacgaaccggcatcccggagcggtttttaatcgcttcatcaagaacaacctggtcaacatctggctgaccggtcactgtctgcacgctcttcgtcagggtaattggcacaatttcctgaccttcaaactgggcttcggtggtagacagcgggttatggacttcaatataacggctgccgtctggctcggtggtcgcttttaccggctcatcaataaactgtacgcgggtaccgaccggtactttctcgaacaggaatttgatgtcttcgttacgcagacgcacacaaccatgacttacacgcaggccgataccgaagttggcgttggtgccatggatagcatacaggcgaccgatatagagtgcatacagccccatcgggttatccggacctgccggaacgacagccggaagcggttcgcccgcagcgcggtactctgcgtgcattttggcggtcggcgtccaggtcgggcctgcttttttacgctcaactttggtggtccagttgataggcgtatctttgcctaactgaccaatgccgatcggcagcacgataacggtgttggtccctttcggatagtaataaagacgcatctcagcactgttaatgacgatgccttcatgaacggtatccggcaggatcagctgctgcggaatgttcagtacagtaccgcctttcggcaggaaggtatccacacccgggttcgcttccatcatattggaaagccccatctggtactcggcggcaaaatactccagcggctgagtgttaccttcaggaatggtgatcacctgattctgaccaaccaggcgactcccgtcggttggcagaggataagttaccgcagaggcggtactgcaaaagccgacaacagcgaaggccgctgcgaataatgttttcaatttcatattcatgttaagcgagattttgtgcctggcaggccattgggttgagaatattagagtattggaagcgcattataagttcattccagctcacagtgaaatcagatgtgtacgaaatcacattttttgcctttggcttgagtgtagaccttaagcgaggagcaggatcttctttcagacttatggcataatgcgcggtttgtcatatctcttttcaggatacgcctgtgttagtttccagtaacgtcaccatgcagttcggcagtaagccgttgtttgaaaacatttccgtcaaatttggcggcggcaaccgttacggcctgattggcgcgaacggtagtggtaaatccacctttatgaagatcctcggcggcgaccttgagccgacgctgggtaacgtttccctcgatcccaacgagcgcattggtaaactgcgtcaggatcagtttgcctttgaagagttcactgtgctggatacggtgatcatggggcataaagagttgtgggaagtgaagcaggagcgcgaccgcatctatgctttgccggaaatgagtgaagaagacggctataaagtggccgatctggaagttaaatacggcgaaatggacggttactctgcggaagctcgcgccggtgaactgttgcttggcgtgggaattccagtggaacagcactacggcccgatgagtgaagttgctcctggctggaagctgcgtgtgcttctggcgcaggcgctgtttgctgatccggatattctcctgctcgacgaaccgaccaacaacctcgacatcgacaccattcgctggctggaacaggtgctgaacgagcgtgacagcaccatgatcatcatctcgcacgaccgtcacttccttaacatggtctgtacccacatggcggatctggattacggcgagctgcgcgtttatccgggtaactacgatgagtacatgacggcggcgacccaggcgcgtgaacgtctgctggccgataacgccaagaagaaagcgcagattgctgagttgcaatctttcgttagccgctttagcgccaacgcctcgaaatctcgccaggcaacttcgcgcgcgcgccagattgataaaatcaaactggaagaggtgaaagcctccagccgtcagaacccgttcatccgttttgaacaggataagaaactgttccgtaacgcgctggaagtggaaggtctgaccaaagggtttgataacggtccgctgtttaaaaatctcaacctgctgctggaagtgggtgaaaaactggcggtactgggtaccaacggcgtcggtaaatcaacgctgctgaaaacgctggtgggcgatctgcaaccggacagcggcaccgtaaaatggtctgagaacgcgcgcattggttactatgctcaggaccacgaatatgagtttgaaaatgatctgaccgtgttcgaatggatgagccagtggaagcaggaaggcgatgacgagcaggcggtacgcagtattctcggtcgtttgctgttcagccaggacgacatcaaaaagccagctaaagtgctttccggtggggaaaaagggcggatgctgtttggtaagttaatgatgcagaagccgaacattctgatcatggacgaaccgaccaaccacctggatatggaatccattgagtcgctgaacatggcactggaactgtatcagggcacgctgatctttgtttcacacgaccgtgagttcgtaagctccctggcgacccgcattctggaaatcaccccggaacgcgtgatcgactttagcggtaattacgaagattacctgcgtagtaaagggatcgagtaagtgattatccgtcaccccgatactgtcggggtgacggcggctgatgacaaatgcaaaatagcctgatgcgctacgcttatcaggcctacgcagtacctgcaatatattgaatctgcaggactttgtaggccggataaggcgttaacgccgcatcaggcattaacaaagcgcatttgtcagcaatctgagtaacgtcgaatcgattttcttaatcccacatcaattcacttccattaattctcaaacatccatgcccaacgctcgcttaccgtgaatgttgaggtcggcaagcgtaaagcgtccttcccagtttgtttcatagtcctcgcgcgggaagtcgcccggcgatgcgcctttttccagtgcggccttcaccttgtgcgcgtaggcaagatttttctcgcacatcggtgccgcaggaatgtacatcacgttgccccaaccttgttgattttcaacgggggcaacggaatggatgacgtcgcagtgccaccagacggagtctccggcttcgagttttggaatgctggttaacgcctcaatcaacagtggatgccattgctctgataccggcaatactcttccgggcgctacgccgcacagttcatcctccggcacatcatcaagcagcggacgtaacagtacgtacgccatagcttcaggaatgggcacgacgtgcagcagcccctgaccaggcagcatatcagagagcgctgtccagccctggaatgtccgaaacacggaacatttggtggtgttgtccaccgtgtactcttcaacttccgtacgatgtgccgcatgccagggatcatattgcgccagattgccattaaagacgttggcgaaaacgcgctgatacgctggaagcagccagcgttccagtgccccggagtcggtatgcgctccaagacctttggaggtcgttccgggcggacggcggcggatacggtcagggtagatgacgctcacatccgggttaaaccattgctttccatcactttcaaatgtccacagacgattgagaaacgactgcgcattcgccatttcttcactctggcgggcctgcatttgcgcctgcgaccagtagatggggtaaatctcgggacgtgaagcgctgagcgtcccgaagaaattatcgccggggcctttgtagacctcgtcaaagcggttgcggtccagatagtccagcatcgactgatcccagcctagcgcttgttcgcgggggaaatggccttttatcaccgcacaaccgcgacgtttaatctgttcgcgctgctctgcagtaacatgacctgctttgatatcggcataagacagcaccggccagacggcatcgccctgtgctttgagtgcgttgatttcagccactcgcgtggcaatgtcatcgcttagctgattaaagatctgctggacgtcgccaagctgcgcccgcagcgcgtgcttcatctgacggatagctgctttgtgatcggcaggcaatgtgtcgctggtaaaagtagaagccataaccacctctcattaactttcattcgaaaccattctgatttgcatgtgacaatataagttataaataagttaatgcaagtttaatgatttgatgtgatgtacaggatgtaaaaagaagggaaaaccggagcgcacggctccggtagagaggtcagctgttaaaaggggatgtgttatccagcaccgcctgaatcacattcagcgcgccttcatgattattatcatcggtagcgtaacgggcgatttgtttaatgttttccgcagcattgcccatcgcaaaggaataacgcgccattttcagcatctccgcatcgttaccgctgtcgccaatcgctaccacattttgcggtgacagatcccagcgtttcagtaaccgcgaaataccgtttgctttatgtagaccgggaataatcaggtcgataaagccaaaaccactggtaacgggtttcataatgccatcgagcgctacgtgcagtttgtcgatcactaacgggatttgttcatccggcaggttgagcgaaaacttgaacagtacgtcgtcaatctcctgataatcttttacaggtttcaggcgatggtagtgttttgccatcagtgcgacaaatgcttcgggggcattttcgctgacatatgcactttgcagaccgcaggcgacaaaattgagttgcttatcttttagcaactcgccaataacaatccgcgattcatgtcgggtcagttcgccgtggaacaactgcttgccatgttcgtaaaccagtgcgccgttttccgcgacaaaagagatctcatcctttagctcaggaaagaatgaaataagctggtaatactgattaccgctggcaacaacgaacttaatgccgcgctttttcagttcctgatattgcgccataaaacgtggttggttgtacgttttggcgtcgttaagaaaagtaccgtccatgtctgtgacgataacttttacgctcataggtgtgctcctggctcgaaaatgaaaccgtaacagtgtaataacaatgtgacgcagagcacaaattatatttcgaatgaaagtaaggatgaaattgatgatgtgaatgatttagcccggcgacgacgccgccgggccgaggagattacagcatatgttcagtacgggcgatgatatcgtcctgagcgtctggagagagcgcggtgaagaacgcggaatagcccgcgacacgcactaccagatcgcgatactgatcgggatgttttttcgcatccagcagcgtttcgcgggaaacgatgttgtactgaatatgccagcctttatgcacttcaaagaaggtacgcagcaggatcatcagtttctgcttgtcagattcgttctccagcgttgccggattcagtttctggttgagcaacacgccgccgagaatcgctgccgtaggcagtttacccactgagccaatgaccgcagtagggccaagatggtcagtaccggaggccgggcttgcgccttctgccagcggggtgtgggctttacgcccgtccggtgttgccatagtctgcgcgccaaacggtacgttagcggagattgatgacgtacccgcgtaatagttgccgccaaccggaccacgaccgtagcgcggattatggtactgtttcagttcgtcgatataggtctgataagcgcgagccagcagcgtatcgacagtatcatcgtcgttgccgtacttcggcgcaccgttaatcagccgctgacgcagctgctcgtgagtcaggccgtcgaagtcatctgccagtgcggcagcaagctgttgctgaccaatcgcaccttgttcaaacaccagtttcttcactgccgccaggctgttgccgaggttggcaatgccgacctgcaggccagaaacccagtcatatttcgcgccgccttgcttgatacttttcgctcgctcaatacagtcatccaccagcgccgagcagagaatatcgtgcacgttctcttccagcatggtgtcgacgacatattcgatttcgattgatttgcgggtgtagtaacggatttgcgtatcccacgcgtccatcacttcatcgaagttgttgaagttacctgccgacaacgctttttcttgtggcaggaacactttgccgctggtggcatcatgcccgccttccagcgccgccagcatcacgcgggcgaagttgataaagctcatgccggtacagcgatagccccatttgccaccgacggcggtttctatacaaccaatcgctgcgtagtcataagcgtcctgcggttcaataccgagtttaataaattccgggatcacgatttcgtcgttgttgaacgccggcatcccgaagccgcaacggatcacctgtacgcaggcgtcgaggaaatcgttgctcattcctgcatggtaacgcacgctgaggttaggctgagtggaacgcaggcgaccgcaggattcgaggatcgcgtaagagagtggattcaccgcgtccattggttgaccatcaaccagattttgcccgccaatagtgacgttctgatacagcggacttcccgcagaggcttttgagtgtgagccggagcggatcttgttcacttccagcagtttcagccagcagctatgcagcatctcgatggcgtgttcgcgatccagcgtctggttgagttcaacgtcgcggcgatagtacgggtagagatactggtccatacgaccaaacgatactgagtgaccgttagattcgatctgcaaaatcaactggatgaagtaacacagttgcagcgcctgccagaaagtctgcggcggctggtgggcgataagatcgcagttttctgccatcgccagcagttcatcgcgacggctttcgcgggtttcggtcgcggccatttcacgcgccagggcagcgaaacgttcaatgtgttcactgactgccaccagcacgatatcaatcgctttcaggaattgctcaccgtgtaaatcttccagcaccgtcaggttgatgcgcgagcgacgttccgctacttcctcgcgcagaccatcaagccctttttccagcagcagcgggaaattcaccgccaggtgcgcatcgccggaggtcatattgccttccgctttaatgattccggtcgccagcagacctttttgctcatcggtaaacatgccgtagcagcgatcctgtacggtctgaccgcgccaccacgggcacacttcatgcagaacgcgtttgttctcttcgctcaccgcaaagccagcaccgggacgatctgccagatcatcaatctctttttcgatccacgagacagtatattccgggaagatcggcgcggcgcgaacttcgcttgcctggttgccaatgatcaactcatcgtgtttgatccagatggtgcgattcgccaggtgatgcgccagtgccagcgcgcgacgtaccgggatcggcttatcgagatgttgttgatacatctcggtatagtgctgcgcgcgctcggtacagactggcggtttcacaatatgcaccagcgcatttttgtgcgctttaatgcggtcgctgagcgtgtccagtttcagtgtggtcatggttgttatcctcgtaaggtcgcggttaaccctttctggcaggcatactgctgggcaaagtcgagcagttctggcgcatcaagcggtttttccggggcgtcatagggcagattaagtaagtgatatttgttgatgcccagcgtgtggtagggcagaaaatgaatttcgccaacgtgcagctcgtcggcggcaaaatcggtaatggcttttacagaggtttcgtcggcattaaagccctgaatcagcggcacgcggataatgatttttttgcccgctgcggcgagttttttcaggttatccagcactctggcggcgttaccgtcggtccactgtttaaacggcgcgtcggcaacgtgttttaaatcggcaagaaacagatcgatatagggcagagaaggggcgatatatttccacggcacatgcagacaggtttctaccgcagtatgaatgcctgcctcgtggctggcttgcagtagcgccatcgccatttccggctgcataaagggctcaccacccgaaagcgttaaaccgccgccgctgcgatcgtaaaacggtttatcgcgcagaacggtcgtcatgatctcctcaacgcttttcacttcaccacacacggttaatgcctgtgtcggacagcagtcggttaacgccgtcagatgctccggggttaacttttcccgatgaataagcaaaccattcagcgcgcgctcaatcacttccggcgcggccttagcgcacagctcgcagccttccagacacagtcgtgcgtcatacagcagatcctgcgtgcgggcgcggctttccgggttctgacaccagcggcagcccagcgaacagcctttaagaaatacgaccgtgcggataccggggccatcatgggtcgagtagcgctgaatattgaaaatcatagttgcctctctatttcgttcaagcattaaaatactttcgaatgaaagttagattgatgtgcgtcaactgttcagagagttttcccgtgatagtctacattcagacaaaaagtacattttgaggatggttatggaactgtatctggatacttcagacgttgttgcggtgaaggcgctgtcacgtatttttccgctggcgggtgtgaccactaacccaagcattatcgccgcgggtaaaaaaccgctggatgttgtgcttccgcaacttcatgaagcgatgggcggtcaggggcgtctgtttgcccaggtaatggctaccactgccgaagggatggttaatgacgcgcttaagctgcgttctattattgcggatatcgtggtgaaagttccggtgaccgccgaggggctggcagctattaagatgttaaaagcggaagggattccgacgctgggaaccgcggtatatggcgcagcacaagggctgctgtcggcgctggcaggtgcggaatatgttgcgccttacgttaatcgtattgatgctcagggcggtagcggcattcagactgtgaccgacttacaccagttattgaaaatgcatgcgccgcaggcgaaagtgctggcagcgagtttcaaaaccccgcgtcaggcgctggactgcttactggcaggatgtgaatcaattactctgccactggatgtggcacaacagatgattagctatccggcggttgatgccgctgtggcgaagtttgagcaggactggcagggagcgtttggcagaacgtcgatttaaccggacgttctgcatcctcataaattgctgatgacgtggcggagtgccgcgtcttatcaggcctggaggtggcaattactgcccacacacctcacaccccggattacgcatcagtttcatttcgcgaaactgacaggtcatcgcatcgtacatgacgattttcccgctggccggtttgccataacctgccagcattttgatcgcttccattgcctgcaacgaaccaattacgccgatcaacggtgccattacgcctgcttccacgcaggttaatgcattttcaccaaacaaacggctaaggcagcgatagcacggttcaccgtcctgataagtaaagacggtgatttgaccttccatacgaattgccgcgccggaaaccagcggtaccttcgcggcaaaacagcctgcgttcagttgattacgtaccgcaacgttatccgtacagtcgagcaccagatcgtgttcagcaatcaatgctgcaagttctgcgtcatccagcagtgcattgactggcgtaatcgcgatatgtgggttgatccgcgtcagggcgtcacgggcggattccaccttcggttgcccgaccgtggcatcactgtgcagtgtctggcgttgcagattcgagagcgaaaccgtgtcgaagtcgagcagcgtcaggttaccgacaccggcgcttgccagatactgcgaggctgcacagccgaggccgcccaggcccactatcagcacgcgagaatctttcagcgcctcctggccgtcaaaatcaaagccgcgcagaatgatttgccggttgtagcgcagcatctcctgatcgctgagttccgccattacaggcctccgaacaacgcgttaaacggttctacttccacccattcgcccacttccacattgccgcgatcgcgttccagcacgataaagcagttgccgaggctaaaggagctaaatatatgtgaaccctgatgtccggtggtcgtcacttccagttcgccatcggcgttgcgttgcagcacgccgcgctggaaatcaagacgtcctggcgtttttttcaggcgggacgctgtgcgtacgcgctggcgcgcgggcaggccgctggcggtgttaccgcttagttttgccagcaaaggctgtaccagttgatagaaggtcagcgtcgctgaaaccgggttgcccggcaggccgcagaaccagctattgctgagtttaccgaacgcgaacggtttacctggtttaatcgccagcttccagaaggcgatctcccccagctcttcaagaatcgttttggtgtaatccgcctcacccactgaaacaccgccggaactgatcaccacatccgcctggctgtcggcttcaataaatgcggcgcgcagggcatggggatcgtcgcggataatccctaagttaattacctcgcatcccaactgttctaacatcaggtgtacggcgagacggttggtatcgtagatttggccgtcgcccagcggctgaccgggcaactggagttcatcaccggtagaaaaaagcgctacacgcactttacgaatcaccggaacttcggcaatccccagtgaagcaattactggcagctctgcggtagtcaggcgagttcccgccgggaaaacaaccgcacctgcagagatatcttcaccgcgacggcgaatattttgcccgctacgcacttcagcagtaaaacgcacgccattgtccatttgttcagtctgctcctgcatcaccaccgcttcgcagccttccggcaccggcgcaccggtcataatacgaatgcaggtacccgcaggccattcaccatggtatggctgaccggcaaaggatttaccggcaacgggcagcggttgcccggaggcaatatcggctaaacgcaccgcgtagccgtccattgcggagttatcaaaccccggaacatcaagcggcgaaacgacatcgctcgccagaatacgaccaaaacactgtaccagtggcagcgtttcctgggcggtcagtggggtgacgcgagaaagcatctcattaagcgcggtgtcgagcgacatcaatccggtggtaaattccatgaaaacactcctgcggaggcaaaatcgaatttgcctattatgtcagaaaaacgccacagactgtatgccacctcgggcgtagcgctgggtcctgcctttacatgccatatccatctttctatattcaaaaattgaatgagtaattcataaaaattctgatatttatagcaaaagtggcgaaccacccttaatggacgaatactatgggcaaagcagtcattgcaattcatggtggcgcaggtgcaattagccgcgcgcagatgagtctgcaacaggaattacgctacatcgaggcgttgtctgccattgttgaaaccgggcagaaaatgctggaagcgggcgaaagtgcgctggatgtggtgacggaagcggtgcgtctgctggaagagtgtccactgtttaacgccggaattggcgctgtctttacgcgtgatgaaacccatgaactggacgcctgtgtgatggatggtaacaccctgaaagccggtgcggtggcgggcgttagtcatctgcgtaatccggttcttgccgcccggctggtgatggagcaaagcccgcatgtgatgatgattggcgaaggggcagaaaattttgcgtttgctcgtggcatggagcgcgtctcgccggagattttctccacgtctttgcgttatgaacaactactggcagcgcgcaaggaaggggcaaccgtcctcgaccatagcggtgcgccactggatgaaaaacagaaaatgggcaccgtgggggccgtggcgttggatttagacggcaatttggcggcagccacgtccacaggcggaatgaccaataaattacccggacgagttggcgatagtcccttagtgggtgccggatgctacgccaataacgccagtgtggcggtttcttgtaccggcacgggcgaagtcttcatccgcgcgctggcggcatatgacatcgccgcgttaatggattacggcggattaagtctcgcggaagcctgcgagcgggtagtaatggaaaaactccctgcgcttggcggtagcggtggcttaatcgctatcgaccatgaagggaatgtcgcgctaccgtttaacaccgaaggaatgtatcgcgcctggggctacgcaggcgatacgccaaccaccggtatctaccgtgaaaaaggggacaccgttgccacacagtgatgaacttgatgccggtaatgtgctggcggttgaaaatctgaatattgcctttatgcaggaccagcagaaaatagctgcggtccgcaatctctcttttagtctgcaacgcggtgagacgctggcaattgttggcgaatccggctccggtaagtcagtgactgcgttggcattgatgcgcctgttggaacaggcgggcggtttagtacagtgcgataaaatgctgttgcagcggcgcagtcgcgaagtgattgaacttagcgagcagaacgctgcacaaatgcgccatgttcgcggtgcggatatggcgatgatatttcaggagccgatgacatcgctgaacccggtatttactgtgggtgaacagattgccgaatcaattcgtctgcatcagaacgccagtcgtgaagaagcgatggtcgaggcgaagcggatgctggatcaggtacgcattcctgaggcacaaaccattctttcacgttatccgcatcaactctctggcgggatgcgccagcgagtgatgattgcgatggcgctgtcatgccgcccggcggtgctgattgccgatgagccaaccaccgcgctggatgtcactattcaggcgcagatcctgcaattaatcaaagtattgcaaaaagagatgtcgatgggcgttatctttatcactcacgatatgggcgtggtggcagagattgccgatcgggtactggtgatgtatcagggcgaggcggtggaaacgggtaccgtcgaacagatttttcatgcaccgcaacatccttacacccgtgcgctgttagctgctgttccgcaacttggtgcgatgaaagggttagattatccccgacgtttcccgttgatatcgcttgaacatccagcgaaacaggccccccccatcgagcagaaaacggtggtggatggcgaacctgttttacgagtgcgtaatcttgtcacccgtttccctttgcgcagcggtttgttgaatcgcgtaacgcgggaagtgcatgccgttgagaaagtcagttttgatctctggcctggcgaaacgctatcgctggtgggcgagtctggcagcggtaaatccactaccgggcgggcgttgctgcgcctggtcgaatcgcagggcggcgaaattatctttaacggtcagcgaatcgataccttgtcacccggcaaacttcaggcattacgccgggatattcagtttatttttcaggacccttacgcttcgctggacccacgtcagaccatcggtgattcgattatcgaaccgctgcgtgtacacggtttattgccaggtaaagacgcggctgcacgcgttgcgtggttgctggagcgcgtgggcctgttacctgaacatgcctggcgttacccgcatgagttttccggcggtcagcgccagcgcatctgcattgctcgcgcgttggcattgaatccaaaagtgatcattgccgacgaagccgtttcggcgctggatgtttctattcgcgggcagattatcaacttgttgctcgatctccagcgtgatttcggcattgcgtatctgtttatctcccacgatatggcggtggtagagcggattagtcatcgtgtggcggtgatgtatctcgggcaaattgttgaaattggtccacggcgcgcggtcttcgaaaacccgcagcatccttatacgcgtaaattactggcggcagttccggtcgctgaaccgtcccgacaacgaccgcagcgtgtactgctgtcggacgatcttcccagcaatattcatctgcgtggcgaagaggtggcagccgtctcgttgcaatgcgtcgggccggggcattacgtcgcacaaccacaatcagaatacgcattcatgcgtagataacattcaggcggagaataaaatggcaagagctgtacaccgtagtgggttagtggcgctgggcattgcgacagcgttgatggcatcttgtgcattcgctgccaaagatgtggtggtggcggtaggatcgaatttcaccacgctcgatccgtatgacgcaaatgacacgttatctcaggccgtagcgaaatcgttttaccaggggctgttcggtctggataaagagatgaaactgaaaaacgtgctggcggagagttataccgtttccgatgacggcattacttacaccgtgaaattgcgggaaggcattaaattccaggatggcaccgatttcaacgccgcggcggtgaaagcgaatctggaccgggccagcgatccggcgaatcatcttaaacgctataacctgtataagaatattgctaaaacggaagcgatcgatccgacaacggtaaagattaccctcaaacagccgttctcagcgtttattaatattcttgcccatccggcgaccgcgatgatttcaccggcagcgctggaaaaatatggcaaggagattggtttttatccggtgggaaccggaccgtatgaactggatacctggaatcagaccgattttgtgaaggtgaaaaaattcgcgggttactggcagccaggattgcccaaactggacagcataacctggcgtccggtggcggataacaacacccgcgcggcaatgctgcaaaccggtgaagcgcagtttgctttccccattccttacgagcaggccacactgctggagaaaaacaaaaatatcgagttgatggccagtccgtcaattatgcagcgttatatcagtatgaacgtgacgcaaaagccgttcgataacccgaaggtccgtgaggcgctgaattacgccattaaccgtccggcgctggtgaaagttgcctttgcgggctatgcaacgccagctactggtgtggtaccgccaagtatcgcctacgcgcaaagttataaaccgtggccttacgatccagtgaaagcgcgcgaattactgaaagaggcgggatatcccaacggtttcagtaccacgctgtggtcgtcacataaccacagcaccgcgcagaaagtgctgcaatttacccagcagcagttagcgcaggtcgggattaaagcccaggtgactgcgatggatgccggacagcgggcggcagaagttgaaggtaaagggcaaaaagagagcggcgtgcggatgttctacactggctggtcggcttcaaccggcgaagcggactgggcactatcgccgctgtttgcctcgcagaactggccaccgacgctgtttaataccgcgttttacagcaataaacaggtggatgacttcctggctcaggcactgaaaactaatgatccggcggaaaagacccgcttatataaggcggcgcaggatatcatctggcaagaatcgccgtggatcccgctggtggtagaaaaactggtgtcggcacacagtaaaaacctgaccggtttttggatcatgccagacaccggcttcagctttgaagacgcggatttgcaataagcaacgcagggagtggaatgcttaattacgttatcaaacgcttactggggttgattccgacgctgtttatcgtctcggtgctggtgtttttatttgtccatatgctgcccggcgatccggcgcgattgattgccgggcccgaagctgatgcgcaggttatagaactggtgcgtcagcagctggggttggatcagccgctgtatcaccagttctggcactatatcagcaatgctgtgcagggggattttggcctgtcgatggtgtcgcgtcgtccggttgccgatgagattgccagccgctttatgccaacgctgtggctgaccataaccagtatggtctgggcggttatatttggtatggcggcgggaattatcgccgccgtctggcgtaaccgttggccggatcgattgagtatgaccattgcggtgtcggggatctcgtttccggcatttgctctggggatgcttttaattcaggtattctccgttgaactgggctggctgcctaccgtgggagcagacagttggcagcactacattttaccctccctgacgctcggcgcggcagtggccgccgtgatggcgcgctttacccgcgcgtcgtttgtcgatgttttaagcgaagattatatgcgtaccgcgagggcgaaaggggtgagcgaaacctgggttgtcctcaaacacgggctacgtaacgcgatgatcccggtagtgaccatgatgggcttacagtttggctttttgctcggtggttccatcgttgtggagaaagttttcaactggccgggacttggacgcttactcgttgactccgtagaaatgcgtgattacccggtgattcaggcggaaattctgcttttctcgctggaatttattcttatcaacttagtggtggatgtgctttacgccgccattaacccggctatcaggtacaagtaaggatgcgactatttaactggcgacgtcaggcggtgttaaacgccatgccactggtcaaacctgaccaggtacgtacaccgtggcatgaattctggcgacgatttcgccgtcagcatatggcgatgaccgccgcattattcgttattttattgattgtggtggccatttttgcacgctggatcgctccctatgacgccgaaaattattttgattatgacaatctgaataacggaccttctttgcagcactggtttggcgtcgattcactggggcgtgacattttcagccgtgtcctggttggtgcgcaaatctcgctggcggcgggcgtgtttgccgtgtttatcggtgcggcgatcgggacgttgctgggcttgctcgctggatattatgaaggctggtgggatcggctgatcatgcgcatttgcgatgtgctgtttgccttcccgggtattttactggcgatcgctgttgttgcggtgttgggaagcggcattgctaacgtgattattgcagtcgccattttttccatccccgcgtttgcccgcctggtgcgcggcaacacgctggtgttgaaacagcaaacctttattgagtcagcacgcagtattggtgccagcgatatgaccgttttgttgcgtcatatcctgcctgggaccgtctcttctatcgtggtgtttttcaccatgcgcattggtacctcgattatctctgccgccagcctctcatttctcggcctcggtgcgcagccgccgacaccagagtggggagcaatgctcaatgaggctcgagcggatatggttatcgcgccgcatgtcgctgtttttccggccctggctatttttctgaccgtactggcgttcaatttgttgggcgatggtttacgcgatgcgctggatccgaaaattaaaggatagttacgtttgaatattgcttgaaagggtaatcacctcacaggaaattattgccctaagcaagtgttgtaactttctgctgattttgtagaatcgggtaatttggttaaaaagccgcagcaagggacaatttttgcagcggcacagcgttcagatagttattttgttaaatgtattaacatgctgagtttatacgaaaagataaagataaggctgataattttatttttattggcagcactgtcatttattggtctttttttcatcattaactatcaactggtatcggagcgcgcggtaaaacgtgccgatagccgctttgaacttattcagaaaaacgttggctatttctttaaagatattgaacgttcggccctgacattaaaggactcactgtatttattaaaaaatacagaggagattcaacgcgccgtgattcttaaaatggaaatgatgccatttttagactcggtgggactggtacttgatgataataaatattatcttttttcgcggagggcgaatgataaaatcgttgtttatcatcaggaacaagtaaatggaccgcttgtcgacgagtcagggcgggttatttttgccgattttaacccatcgaaacgaccgtggtcggtggcttcagatgactctaacaacagctggaatccggcatacaattgctttgatcgtccgggtaaaaaatgtatctcttttacgctacacatcaacggcaaagatcacgatttgttagcggtggataaaattcatgtcgatttaaactggcgatatctgaacgagtatcttgatcaaatcagcgctaatgatgaagttctatttttgaaacaaggccatgagatcattgccaagaatcaactcgctcgtgaaaaactgattatttataatagcgaaggtaattataatattattgattctgtcgatactgaatatatcgaaaaaacatcagcggtgccaaacaacgcattattcgaaatctatttttattatcctggcggtaatttattgaacgcatcagataaacttttttatctgccgtttgcgttcattattatcgtattgctggtggtttatttaatgaccactcgtgtgttccgtcggcaattttctgaaatgacagagctggttaatacgctggcgtttttgcctgactcaacggatcaaatcgaggctctgaaaattcgtgaaggcgatgcgaaagagattatcagcatcaaaaattcgatcgcggaaatgaaagatgccgaaattgaacggtcaaataaattgctctcactgatctcttacgatcaggaaagtggttttattaaaaatatggcgattattgagtctaacaataatcagtatctggctgtggggatcatcaaactgtgtggtctggaagccgtggaagcggtgtttggtgttgatgagcgcaataaaatcgtcaggaaattgtgtcagcgaattgccgagaaatatgcgcaatgctgcgatatcgtgacattcaatgccgatctctatttacttctgtgtcgggaaaatgtacagacatttacccgtaaaatagcgatggtaaacgattttgacagcagctttggctaccgcaatctgcgcatccataagtctgccatttgtgaacctttgcagggggaaaacgcctggagttacgcagaaaaactgaaactggcgatttccagtatccgtgaccatatgttctcagagtttattttctgtgatgacgcgaaactcaacgaaatagaagagaatatctggattgcgcgtaatattcgccatgcaatggaaattggcgaactattcctcgtctatcaaccgatcgttgatattaacacccgcgccattctgggcgcggaggcgttgtgccgttgggtgtctgcggagcgggggatcatttcaccgctgaagttcattaccattgctgaagatatcgggtttatcaatgagctgggttatcagattattaaaacggcaatgggtgaattcagacattttagtcagcgtgcgtcgctgaaggatgatttcttactgcatattaatgtttcgccctggcagttaaacgaaccacactttcatgagcgttttaccaccatcatgaaagaaaatggcctgaaggcgaacagcctctgtgttgagatcactgaaaccgtgatcgagcgaattaatgaacatttttatctcaatattgaacaactgcgtaaacaaggggtacggatatcgattgatgactttggcaccggtttgtcaaacctgaaacgtttttatgaaattaatccagacagcataaaggtggactcgcaattcaccggcgatattttcggtactgcgggaaaaattgtgcgcattattttcgacctggcacgctataaccggatcccggtgattgcggaaggcgtagagagcgaagacgttgcgcgcgaattaatcaaattaggatgtgttcaggctcaggggtatctgtaccagaaacccatgccattctccgcctgggataaaagtggaaaattagtaaaagagtagtttacgtatgtccagaatcaataagttcgtacttacagtcagtctgctgatttttatcatgatttcagcagttgcctgcgggatctacactcaaatggtaaaggaacgggtgtatagcctgaaacagtccgttattgatactgcttttgcggtggcaaatattgctgaatatcggcgtagcgtggcaattgatcttatcaacacgctaaatcccacggaggaacagctgttggttggtttgcgcacagcttacgccgactcggtttccccctcttatttgtacgatgtcggtccttatctgatttccagtgacgaatgtattcaggtaaaggagttcgagaaaaattattgtgcagatattatgcaggttgtgaagtatcgacatgtcaaaaatacagggtttatctcttttgacggtaaaaccttcgtctattacctctatccggtaactcacaatcgtagtctgatatttttgcttggtctggagcgtttttctttactgtcaaaatcgctggcgatggacagcgagaacctgatgttctctctatttaagaacggtaaaccggtgaccggtgatgaatataatgctaaaaacgccatcttcaccgtttcggaagcgatggagcacttcgcctatttgccgaccggattgtatgtatttgcgtataaaaaagatgtttatttgcgggtttgtacattgattattttctttgccgcattggtggcagtgatatcgggtgccagttgcctctatctggtacgcagagtgattaatcgtggtattgtggagaaagaagccatcattaataaccattttgaacgcgtactggatggcgggcttttcttttcggctgccgatgtcaaaaaactctacagtatgtataactcggcgttcctggacgacctgaccaaagcaatgggcagaaaatcctttgacgaagatttaaaagcgctgccggaaaaaggcggttatttgtgcctgtttgacgtcgataaattcaaaaacattaacgacaccttcggtcatttgctgggcgatgaagtgttgatgaaagtggtgaaaatccttaaatcacagatcccggtagataaaggtaaagtctaccgcttcggcggtgacgaatttgcggtgatttatacgggtggaacgctggaagagttgctatcgattctaaaagaaatcgttcatttccaggtgggaagcattaatttaagtaccagtatcggtgtagcacattcaaatgaatgtcctaccgtcgaacgcttgaaaatgctggcggatgagcggctgtataagagtaagaaaaacggcagggcacagattagctggcagtaatcattattcgcaggccggacaaatgattttgcccggcctgaattaattaaacccggctaccccacaaatcgtactcatcggcgtgctcgactttcacacgcaggatatcacccggcttaacgttggtttcaccattgagataaaccgcgccgtcgatttccggtgcatctgccatgctgcgaccaatcgcgccttcttcgtccacttcgtcgataatcaccagaatttcacggcccactttctcttgcaggcgctcggcggaaatctgctgctgcagctgcatgaaacggttccagcgttcttctttaacttcttccggaacctggtcaggcagggcattggcgtctgcaccttcaaccgggctgtatttaaagcagccaacgcgatccagacgcgcttctttcaggaagtcgagtagcatctggaaatcttcttctgtctcgccagggaagccgacaataaaggttgagcgtagggtcagttccgggcagatttcgcgccactgtttgatgcgcgccagttggcgatctacagaacccggacgcttcatcagtttgagaatgcgcgggctggcgtgctgcaacggaatgtccagatacggcaggattttgccttctgccatcagtgggatgacgtcgtccacatgcggataagggtaaacgtagtgcagacgtgtccagatccccagtttcgataactgttcgcacaggctgaccatgctggtttttaccggctcgccgttgtggaagccagtacgatgtttaacatcaacgccataggcggaagtatcctgcgagatcaccagaatctctttaacgcccgcatctaccagacgtttcgcttcacttaacacttcgccaatcggacggctcaccaggtcgccgcgcatagacggaataatgcagaaggtgcagcggtgattacagccttcagaaattttcagataggcataatgacgcggcgtcagtttcacaccttgttctggcaccaggctcaggaatgggttgtgtttcggttttggcacgtagtgatgaacgtgctccagaacctgctcatagctatgaggcccggtgatttccagcactttcgggtggacttcgcggatctgatcttcttttgcccccagacaaccggtcacaataaccttgccgttttcattcaacgcttcaccaatggcttccagtgattcttgtaccgcgctgtcaataaagccgcaggtgttgacgatcaccatgtccgcatcgtcatagctcggtaccacgtcataaccttcagtgcggagttcggtgagaatacgctctgaatcaacaaggtttttcggacagccaagggaaacaaagccgattttcggctggggagttactttgctcatagcttaaaaaatattcagttacaggaaaggtcagggcagggattctacagagttctggataaaatttgtatcgcaatctcattcgctggcggaggcgaaggaaatgtaaattttgttaattcggcgtgaagaattgatcctggacagcattttgctcaaaaaatagccatactatttaattgcaacaaggctgggaagaggaggatcgaagtatgttcgttgacagacagcgaatcgatctgctgaaccggttgatcgacgcacgcgttgacctcgccgcatacgtgcaactgaggaaggcaaaaggatacatgtccgtcagcgaaagcaatcatctacgagataacttttttaaactgaatcgcgaactgcacgataaatcgctgcggttgaatcttcatctggatcaggaagagtggagtgctcttcatcatgctgaagaagcattagcgacagccgcagtatgtttgatgagtgggcaccatgattgcccgactgttattaccgtcaacgccgataagcttgaaaattgtctgatgagcttaacgctgagtatccagagcctgcagaagcacgccatgcttgagaaggcctgaaaactaagggggagaaagcgtctcccccttcatgtttaagtttttgtaaaaatgaatttgttatctcctccactgactacgctttaagccagagtcaatccggaggcgttatgcatcgacaatcctttttccttgtgccccttatttgtctttcttccgctctctgggcggctcctgcaacggtaaatgtcgaagtactgcaagacaaactcgaccatccctgggcactggcctttttacccgataatcacggtatgttaatcactctgcgcggcggcgagttgcgtcactggcaagcaggaaaaggattatctgcgccgctttccggagttccggacgtttgggcgcacgggcagggcggcctgctggacgtggttttagcgcctgattttgctcagtctcgccgcatctggttaagttattccgaagttggcgatgatggcaaagccggaactgctgtgggttatggccgcttaagtgatgatctctcaaaagtgaccgacttccgcaccgtctttcgccagatgccaaaactgtctaccggcaaccattttggcgggcggctggtattcgacggtaaaggttatctttttattgctctgggcgaaaacaatcagcgcccgacggcgcaggatctggataaattacagggcaaactggtgcgtctgaccgaccagggcgaaatcccggatgataatccttttataaaggaatccggtgcgcgcgccgagatctggtcttatggcattcgtaatccgcaaggaatggcgatgaatccgtggagtaatgcactgtggctgaatgaacatggcccgcgcggtggtgatgaaattaatatcccgcaaaaaggcaaaaactacggctggccgctggcaacctggggaatcaactattcaggctttaagataccggaagcgaaaggggagatcgtcgccgggaccgagcaacctgttttttactggaaagattcgcccgctgtgagcggcatggccttctataacagcgataaattcccccagtggcagcaaaaattatttattggcgcgctgaaagataaagatgtcattgtgatgagcgtcaacggcgacaaagtgacagaagatggccgtattttaacggacagagggcagcgaattcgtgatgttcgcactggacccgacggttatttatacgttctcaccgacgagtccagtggggaattacttaaagttagcccacgcaattagctaacgggaatcatcaccactttgcgcactgcggggcgttcagtgagttgctgataccagcgttgcagatttggacgcggtgtccaggtcaggccaacgttaaacaaattgtagatgaacggtgcgatagcgatatcgcccacaccaaactcgtcgccagagaaccattttacttttgccagttccgcatcgagcagggcaaacagggcgtcgcactctttgcaactggcatcaatggcggcctgatcgcgctcttccggtggtgttctgactaatcccatcaggatcccgcgatgagcattactgagcgtctggtttgcccagtccatccatttttccgcttccgcacgacgtgccggtgagtcgatccacaggcgtttttgcccgtactgtgccgccagatagcggacaatggcgtttgattcccaaagaatgagatcactttcgtcgtcacgcaacaacggcaccagcccgttagggttcatcgccagaaaatcagcatcgtgatttatcccaaactcacggcccgcgagaatttgctcataaggtagttccagttcttcgagcgtcagcaatactttttttacgttagttgaattattccgaccccacagcgtaatcatactcaccccttttccgacaggcagccacaggctgaacaggactccgatggtgaagtaaagttaacttttaagcaacagctggcaaaaaaatgacaccagaagcagcgaagcggcaggatattgcataaactttaaaaactttaccaacttacggtttctttaagtttgtgtgtgcgttattaatcaccaaacttatcatacggcgatataacgtattttttttgaatggatactcgggtggcatttatgacgcaatactcctctctccttcgtggtcttgcagcgggttctgcatttttattcctttttgccccaacggcattcgcggcggaacaaaccgttgaagcgccgagcgtggatgcgcgtgcatggattttaatggattacgccagcggtaaagtgctggcagaaggcaatgcggatgagaaactggatcccgcgagcctgactaaaatcatgaccagctatgtggttgggcaggcgcttaaggccgataagattaaactcaccgatatggtgacggtcggtaaagatgcctgggcgacgggaaatccggcactgcgtggttcatcggtaatgttcctcaaaccgggcgatcaggtttcggtggcagacttgaacaaaggtgtgattatccagtccggtaatgacgcctgtattgcgctggctgattacgttgccgggagccaggagtcatttattggtctgatgaatggttatgccaaaaaactgggtctgaccaacactaccttccagacggtgcacggcctggatgcgccggggcagttcagcaccgcgcgcgatatggcattgctgggtaaagcattgatccacgatgtgccggaagagtacgccattcataaagagaaagagttcaccttcaacaaaattcgtcagcctaaccgtaaccgtctgctgtggagcagcaatctgaatgttgatggcatgaagacaggaaccacggcaggcgcgggatataatctggttgcttcggctacccagggcgatatgcgtttaatctccgtagtgttgggggcgaaaaccgaccgtatccgttttaatgagtctgagaaattattgacctggggtttccgcttctttgaaaccgtgacgccaattaaacctgatgccacctttgtgactcagcgcgtctggtttggtgataagagcgaagtgaatctcggggcaggtgaagcgggctcagtgaccataccgcgtgggcagctgaaaaacctgaaagcgagttatacgttaacggaaccgcagcttaccgcaccgctgaaaaaaggtcaggttgtcgggaccattgatttccagcttaacggtaaatccattgagcagcgtccgctgatcgtgatggaaaatgtggaagagggcggattctttggtcgggtgtgggatttcgtgatgatgaaattccatcagtggttcggcagctggttctcttaatcttctgataaccggatggcgcgaaacgtcatccggttatacgtcattaatacatcaacttaatgcgctgcgtctgcgcgtacttcacatactcatcttccgggcaacaatcgctcaccacaatatcaaagcgtttcaggtcacccatgcgcgccggacgcaccttgccaaatttactgtggtcgacaaccagcacatgcttttgcgccatcgacatggcccagtgttttaccggcaactcttcaagattaaaacaggtagcgcctttactgacatgcacgcccgccgcagaataaaaagcgatatccgggcaaaaattattcagcgtttgctgaaaatcgatgggtttgaaaatggcgttgctggcgtgaaattcaccaccgcaaagaaacgcgcggcaatggggtttctctttcagcgccagaaaggtatttagcgaataacaaacggcggtaaaagggatttcattatcaatcgcttcaataatccacggcgtggtggtgccacagtcaaaaaagagggtctgatcgggttctaccagcgtcgcagccagttttgccgcccggcgtttttcttccaccaggcgggatttttgatcgcttaacaggtaatggctggcactgcgcggttccagaacaatatagccgccgagcaaaacgacgggcgcactgtggttgttcagatcgcgacgaatcgtcatctccgaaaccccaagcagggcggcggcgtctttaagatgtaacttatcgctgcgttttaattcttgcagcagctgcccgatacgctcttcgcgacgtgtttccataatccctctgaatagttattgaagcgagccgctcaatactacactttttagcagagatcagtcacgcacccagcctttgcggatcggtaatgcaaaacagacgcgataccacgattgcagacgttgatagagtttatgccccatcgcttgccagataatctgggcactaaggcagccaatcatacctgccagcaatccaccgagcatatccagcggccagtggacgccaagataaacgcgcgaccaggcaatgacgacggccagcaccattaaaagtgagccggaccacaggcgatgccagcataaaaatgccagtgcaaaggtgaaaatcaccgtaccgtgatcgcttgggaatgagtcatccgccgcatgatgcaggaagttatagccgatattttcgacaaagggtcggtcgtgcggaaaaagatgtcccatcgtccaggacacaaacaggctgaccgccagcgcgatagcgatttttatcaccagttgccgttgtgctgtaagcccccacaaccaaagtaccacggccagcaacggcaccacggtaatcaaatctttagcaataaaaatcgccaacgagatcatccacggagccgagtctggcgtcgcgttaataagagagaatagagagagattcaaattttccagcataacttcccgacgcaaagtgattaaaagggagccaatacaggcaagtcgttgagaataaagtgcaggttaaactgggtaaagcggcatcgtcttatttccctcaagcggcctgtttacggtgggtgattgtaacgggcataggttaaataaaacttaaagaaagcgtagctatactcgtaataatgtaagaatgtgcttaaccgtggtttcagctacaaaattcgctttctcgttagctgcgcttttattaaactctgcgcgattattattggcgaagaaattgcatgcaaaataaattagcttccggtgccaggcttggacgtcaggcgttacttttccctctctgtctggtgctttacgaattttcaacctatatcggcaacgatatgattcaacccggtatgttggccgtggtggaacaatatcaggcgggcattgattgggttcctacttcgatgaccgcgtatctggcgggcgggatgtttttacaatggctgctggggccgctgtcggatcgtattggtcgccgtccggtgatgctggcgggagtggtgtggtttatcgtcacctgtctggcaatattgctggcgcaaaacattgaacaattcaccctgttgcgcttcttgcagggcataagcctctgtttcattggcgctgtgggatacgccgcaattcaggaatccttcgaagaggcggtttgtatcaagatcaccgcgctgatggcgaacgtggcgctgattgctccgctacttggtccgctggtgggcgcggcgtggatccatgtgctgccctgggaggggatgtttgttttgtttgccgcattggcagcgatctcctttttcggtctgcaacgagccatgcctgaaaccgccacgcgtataggcgagaaactgtcactgaaagaactcggtcgtgactataagctggtgctgaagaacggccgctttgtggcgggggcgctggcgctgggattcgttagtctgccgttgctggcgtggatcgcccagtcgccgattatcatcattaccggcgagcagttgagcagctatgaatatggcttgctgcaagtgcctattttcggggcgttaattgcgggtaacttgctgttagcgcgtctgacctcgcgccgcaccgtacgttcgctgattattatgggcggctggccgattatgattggtctattggtcgctgctgcggcaacggttatctcatcgcacgcgtatttatggatgactgccgggttaagtatttatgctttcggtattggtctggcgaatgcgggactggtgcgattaaccctgtttgccagcgatatgagtaaaggtacggtttctgccgcgatgggaatgctgcaaatgctgatctttaccgttggtattgaaatcagcaaacatgcctggctgaacgggggcaacggactgtttaatctcttcaaccttgtcaacggaattttgtggctgtcgctgatggttatctttttaaaagataaacagatgggaaattctcacgaagggtaaaaaaatgcctgactgctttgtgcgatcaggcattctcgaattaatggtgatggtcgtcaatctggtgttcgataaccatcccttcacctacgctggcaagatggcgaacataaggatgcgggcggtaagccggagctggcgcaggagccacatagacggtttgcggcacagtcgcgacgctgaccgcttgtggaacgctgactgaatcaggaaccacaaccactttgtatccactcggcacatcgacggtgacactttgcgccatcgccacaccagtaaagcccattaaaagcgcgcccaacagtagacaatttttcataatcatttcgcctgaaataatgcagcgggttaatttccgcgaattatgcagccttcattcaggcattgtgttgccgggcgtgctgccggttttattggtcaaatggcgcttcgtgtttaagaactttatcgatcacatccagtacgccttcacggttattggagcctgcgcggtattttgccgctgcgacgaccgcgctaccggcattttccattgcaaaactaaagcctgcctgacgcagcatctcaatatcgttaccgccatcgccaaagaccaccacttcgctgtcgtctattccccataatttctgcagttggcgaaggccattggctttatgtacgccggggataatcagatcgatgctgccgttgccggtgtggaccgacaccataatatcgccgatggcctcatgtaatgctttttgtacttgtggaatcagttcatcggaaagattcaggccaaacttaaagaagatatcctctaagttgtcaaagttatcgacgtattccagacggtgataatacatttccgccaccgttttcatggcatcgtcatattttttgagtgtataggcactattttttccgcaggcaataatttccacttccgggcgcgtcagcaaatgttccacgacagtagcaaacgcatccttcgatagctcgccattaaaaacatctttgccttcgctcactacccagccgccgttttcagccacaaaggcaatttcattagcaatttcagggaagaaagagatcaactgataatattgattcccgctggcgactacaaagcgaattccttgtgctttcatttgctgatactgagccataaaccgctcacggttataggttttttgatcgcttaagaaagtaccatccatgtctaccgcaattaatttaatgctcatcaactattctccatcgccgtctgcgttttggtatcgggtttggcgacggctttcgcgacaatagccgcgagaataaccagcgccagtacaaccagcattgcactacgtaatccataatgttcgccgagatagcccagcagcggcggcccgacgaggaaagccagataaccggtcgttgctaccacactgacgcgggttggtgcatcggggccggtatcgctggcggcagaaatggtcagcgggaagcccagcgaggcacccagtccccagagtacaacagacaccccagcgacccaggcgctatcgacaaaaataatcagcccaatacccaacgcccccattagtgcactggcccgaaccacggcaacgcgactgtaacggtcgatgaaccaaccgccggtgaagcgtccaacggtcatccccagggtaaaaccggcataaatcagcgagccggaagtagggctaaaaccgtgaccgtcaaccattaataagggtaaccagtcgttggcagaaccttcggcaaaggccatcgccagcaccacaacacctatcagcagcaactggatatcgcgataaaaaggtacgcctttttcgccatgctgggtgccatcggcagcatttttgcccgtaccgtcagggattgcctgaatggcgatataaataggtgcgatacctaccagcgccgccaataaaatgtgcaccgttgccggaacgccaaaggccgtcagtgccatcccgacacctgcgcctgccagcgtgcccaggctataaaaaccgtgcatcatcggcaaaaccgtcttattcatttctcgctcaacggcagcaccttcaacgtttatcgccacttccgcagaaccaaaacttgccccaaagacgccgagaccaacggcaaagagcaggggcgatgtcagccagagtgccagacttaatatcatcatcccgatcaatgcgcaggacatcgtgaccaggatgacattacgtgtcccaaagcgtttcactaaccacgccgagcagagaataccgctcatcgaaccgatcgacagaccaaagagaacaccgcccatttcagcgatcgagacagagagaatatcgcggatagcaggcgtacgggttgcccaggacgccattaacaggcctggcaaaaagaagaacataaacagcgcccaggttcggcgtttcaatgcattacgtgaagaatttacggtcatagatcacgtcaaaataagaagagggaagacaacattagcaaggttgtgtacatttgtacacaattgcagagagaggaaatgacatgcgtcgcgctaacgatccgcaacggcgagaaaaaattatccaggccacgctggaggcggtgaaactttacggaatacatgctgttacgcaccgcaaaattgctacccttgccggggtaccgttgggatcgatgacctactatttttcaggaattgatgagttgttactggaggcgttcagcagttttactgagatcatgtcccggcaatatcaggcattttttagcgatgttagtgatgctccgggcgcatgccaggctatcaccgatatgatctacagctcacaggttgcaacgccggataacatggagctgatgtaccagctctacgcgctggctagccgaaaaccgctattaaaaacggtaatgcaaaactggatgcagcgcagtcagcaaacgctcgaacaatggtttgaacccggaaccgcccgcgcgcttgatgcgtttattgaggggatgacgctgcattttgtcaccgaccgtaagccgctatcgcgcgaggagattttgaggatggttgagagggttgcagggtagtagataagttttagataacaaaaaacccatcaaccttgaaccgaaatggcggggttgatgggctccacaaaatggggacatcaaagaaaagcagtggcactaattaagactgatgccctgcggaaaagttctgcggttgtgcaaaaaaatttcattttcagggcaacttcagttttatcctaatcctggccataccatgacgatgattgtccctgccagcgtcagcaggacgttggcgattgcataggtgcccgcatagcccagcgccgggatgttactgcgagctgtatcactgatgatctccattgccggcgcgcaggtacgtgcgcccatcattgcgccgaacaacagcgcgcggttcattcgcaatacataagcaccgaacaagaaacagataaccacgggcaccagactgacaatcaatccggcaatcaacatctgaccgccaatcgcgcccaggccgttattaataccgctaccggcgctcagaccaacgcctgccataaacaccatcaagccgaactctttcaccatgcttaatgcaccctgcggaatgtaaccgaaggtcgggtggttagcacgcataaagcccagcataattccggcgaataacaacccggcagcgttccccatgccgaaactgaatgtgctgaactggaaggtgatcatcccgatcatcagcccaataacaaagaaggcgcagaatgccagcaggtcagtgacctggctgtgaatcgagataaagccgatgcgatcggcgatggtttttacgcggcgggcatcgccgctgacttgtaaaacgtcacctttgttaagcacgacgttgtcatctatcggcatctcaatctggctacgaatgacgcggttaaggaagcaaccgtgatcggtcaacttcagttgtgcgagacgtttacctacagcgttatggtttttaacgaccacttcttcagtgacgatacgcatgtcgagaaggtcacgatcgaaaacttctttaccgttacggaagctgggatcgagtcgggcatgggcgtcgggatagcctaccaacgctatttcatcgcccatttgtagcacggcatcaccgtctggatttgccagaatcccgttacgtcgaatacgttcaatgtagcagccggtttgtcgataaatacccagttcacgcagatttttgccgtcggtccaggccaccagttccgggccgacgcgataggcgcggatcaccggtaaataaaccttacggttggcatcagtgtccaggccacgttcgcgggcgatttgctgggcgctggtctgtaagtcctgatgctgcaatttcggcaagtaacgcgcaccaacaatcaaactcaccagaccgattaaataggttaaggcatacccgaggctcagattatccagtgccagtgagagctgcctgctttccatgccggaatgacgcagtgtatcgccagcaccgaccagaaccggtgtcgacgtcatagagcctgctaacataccggccgtcaggccaatatcccagccaaacagcttacctaaccctaaggcgatcaccagcgcactgccaaccatcaccagtgctaacattaggtaatttttcccatcgcgaaaaaaaatggaaaaaaagttcggtccggcttcgaccccgacgcagaaaataaacagcataaagccaagattaagcgcatcggtgttaatgctgaaatgttgttggcctaataacagcgatacgactaaaacgccaatggaattacccagttggatcgaaccaagtcgtaactttccgagacatagcccaagcgcgaggaccacaaataataacagaatgtaattcccatttaacaattcggcgacgtttatattcacggaggctaacttcttgtttactagtaagctgttgaaagaaatggtaatttacgataatgttttttaccagaattcagggcgcagattcattcagcgcacctaaacgatagtaaagtaacaatatattttactagtgtaatcacattaggtatcaacggctatatgaattgcgttggcctatattagcatggaatgcgaagcggctttatcttactgaacgccacactggcgaaaaatgtgttcgatagacgcagtgtcaggaggaacgagtgaaacataaacaacgttgggcgggggcaatctgctgttttgtcctcttcattgtggtgtgcctttttctggcgacgcacatgaaaggcgcttttcgggctgccgggcatcctgaaatcggcttgctatttttcattcttcctggagcagtcgccagcttcttttcacagcgtagagaagtcctgaaacctctgtttggcgcaatgctggcggcaccctgttcgatgctcattatgcggctgtttttttcaccgacgcgctcattctggcaagagctggcatggttactaagcgcggtgttctggtgtgcgctgggggcactgtgtttcttatttatcagtagtttgtttaaaccacagcacagaaaaaatcagtaaagccctcaacgcgagggcttgtcagacgatcaggcgtccagattttctttcacccatgcagcaaaatcggtatagccgccgatatgttgctgatcgacaaaaatctgcggcacggtttctacgggtttacctgccttttgttgtagatcttctttagtgatcccttccgcacgaatatctacatactgatactgaaaatcatcgcgttcattgctcaatttctcagccagatcttttgcacgcacacagtaagggcaacccgaacgaccaaaaataacggtttgcattatttctctcctcatagatttatgcctgtaatgatcacgctaaaatgtattcgctgaaagtaggtttaacctgttgcattaattgctaaaagctataactgttaaacacaatacagtgaaaagttttagactgaaggctcactttgcagagggaagcgtatgcgcgcgatcggtaaattgcctaaaggcgtgttgatactggaatttatcggaatgatgctactggcggtggcgctgctgtcggtaagcgactccctgtcgctgcctgagccattttctcggccagaagtgcagattctgatgatttttctcggtgttttgctcatgcttcccgctgcggtggtggttattcttcaggtggcaaaacgtcttgccccacagctgatgaaccgtccaccgcaatattcacgttcagaaagagaaaaagataatgacgccaaccattgaacttatttgtggccatcgctccattcgccatttcactgatgaacccatttccgaagcgcagcgtgaggcgattattaacagcgcccgtgcgacgtccagttccagttttttgcagtgcagtagcattattcgcattaccgacaaagcgttacgtgaagaactggtgacgctgaccggcgggcaaaaacacgtagcgcaagcggcggagttctgggtgttctgtgccgactttaaccgccatttacagatctgtccggatgctcagctcggcctggcggaacaactgttgctcggtgtcgttgatacggcaatgatggcgcagaatgcattaatcgcagcggaatcgctgggattgggcggggtatatatcggcggcctgcgcaataatattgaagcggtgacgaaactgcttaaattaccgcagcatgttctgccgctgtttgggctgtgccttggctggcctgcggataatccggatcttaagccgcgtttaccggcctccattttggtgcatgaaaacagctatcaaccgctggataaaggcgcactggcgcagtatgacgagcaactggcggaatattacctcacccgtggcagcaataatcgccgggatacctggagcgatcatatccgccgaacaatcattaaagaaagccgcccatttattctggattatttgcacaaacagggttgggcgacgcgctaaaaccgccacgtcgatgtatgatacgcgggcttttgaccaggtctgacagagaggtgcagggtgaaaattgccatattgtcccgggatggaacgctctattcgtgtaagcggctgcgtgaagccgctatacagcgcggtcacctggttgaaattcttgatccgctttcttgctacatgaacataaatcctgcggcgtcttctattcactacaaaggccgcaagttaccccattttgacgcagtgatcccgcgtattggcaccgccattaccttttatgggacggcggcactgcgccagttcgagatgctggggagctatccgctcaatgagtcggtcgccattgcccgggcgcgtgacaaattgcgttccatgcaactgctggcgcgtcagggcatcgacctgcctgtcacgggcattgcgcattcgccggatgataccagcgatttaatcgacatggtcggtggtgcgccgctggtggtcaagttggttgaaggcacgcagggaattggcgtcgtgctggcggagacgcgtcaggcggcggaaagcgtgattgacgctttccgcggtctgaacgcgcatattctggtgcaggaatatatcaaagaggcgcaagggtgcgatatccgctgtctggttgttggcgatgaagtggtcgctgcgattgaacggcgggcgaaagagggcgattttcgttccaatttgcatcgtggcggcgcggcaagcgtcgccagtatcacaccacaggagcgtgaaatcgcgataaaagccgcgcgaacgatggcgctggacgttgctggtgtggatattctgcgtgctaatcgcgggccgttggtgatggaggtgaatgcgtcgccggggctggaaggaatagaaaaaaccaccggtatcgacatcgcgggtaaaatgatccgctggatcgaacgccacgctacgacagaatattgcctgaaaacgggtggttagtcgcaatcacattactgatcatggttttgcctgcgctttttgcgtaagctgtgccggtctttttatcgaaagaggttgtacaaaattatgacatcgctggtcgttcctggtctggatacgctgcgtcaatggctcgatgacctggggatgagtttttttgaatgtgataactgtcaggctctgcatctgccccatatgcagaatttcgacggtgtctttgatgccaaaatcgatctgatcgataacacgatcctgttttctgccatggcggaagtccgaccttcagccgtattgccgctggcggcggatttatctgccatcaatgccagttcgctgaccgtgaaagcatttcttgatatgcaggatgataatctgccaaagctggtggtttgccagtctttatccgttatgcagggcgtaacctatgagcagtttgcatggttcgtgcgtcagagcgaagagcagatttcgatggtcattcttgaagctaatgcccatcaactgctgttaccgactgatgatgaagggcaaaacaacgttaccgaaaactatttcctccactgataactcctttcgagcacgcagtcgctggtgcagtggctgcgcgctgcaaaattatctgctgtttttaaccttttcttaaagattatttcacttctcttgtgtcgatttggctttatcacatagagcaaatatgcataaaaatttgttaaataccgttttttaatccgagctatagtctcaaaccctggctaaagttattcttgcgatgcttttatatagcgagcagtgctggccgggagaaagttctcttttcttacaccgcgccgataaaaaatatgcacgtttattgcatatctttcagtgtgacaacttttgttcgtttgttaacgaactttcagaaggaaagagatatgaccgccttaaataaaaaatggctatcgggtctggttgcgggtgctctgatggccgtctctgtcggcacgctcgcggctgaacaaaaaacactccacatttataactggtctgattatatcgccccggacacggtggccaattttgaaaaagaaaccggtattaaagtcgtctacgatgttttcgactctaacgaagtactggaaggcaaattaatggccgggagtaccggctttgatctggtggttccatctgccagctttctggagcgccagttgactgcgggagttttccagccgctggacaaaagcaaattgccggagtggaagaatctcgacccggaactgctgaagctggtcgccaaacacgatcccgacaataaatttgctatgccctatatgtgggcgacgaccgggattggctataacgttgataaagttaaagcggtgctgggcgaaaacgcgcccgtcgatagctgggacttgatcctcaaacctgaaaatctggaaaaactgaaaagctgcggtgtctctttcctggatgcgccagaagaagtttttgctaccgtgttgaattatctcggcaaagatcccaacagcactaaagcggatgattacaccggaccggcaacagatctgctgttaaagctgcgcccgaacattcgttatttccattcatctcaatacattaacgacctggcaaacggcgatatttgcgtcgctatcggctgggcaggtgatgtctggcaggcgtcaaaccgcgcgaaggaagcgaagaatggcgtgaatgtctcgttctcgattccaaaagaaggggcgatggcgttctttgatgtattcgccatgcctgcggatgccaaaaacaaagacgaagcctatcagttcctgaattacctgctgcgcccggatgtagtagcgcatatttccgaccatgtgttctatgccaacgccaataaagcagccacgccgctggtgagtgcggaagtccgtgagaacccaggtatttatccgcctgcggatgttcgtgcgaagctgttcactctgaaagtgcaggatccgaaaatcgaccgtgtgcgcacccgcgcgtggaccaaagtgaagagcggaaaataatccgcagtcgtagatgccggaggggcgcaccacacccgccggcaattcgcaccattatggtgcgcttgcacacattcaatgccggagagcagccgtgaatgacgctatccctcgcccgcaggcgaaaacccgtaaggcgctgacgccgctattagaaatccgcaacctgaccaaatcctacgatggtcaacatgcggtggatgatgtcagcctgaccatctacaaaggtgaaatcttcgcgctgctgggcgcatccggctgtggcaagtccacgctgctgcgtatgctggcaggtttcgaacaaccttctgccggacagataatgcttgatggcgtcgatttgtcacaggttccgccttacctgcgccccatcaatatgatgtttcagtcttacgcgctgtttccgcatatgaccgtggaacagaacatcgcttttggcctgaaacaggacaaactaccgaaagcggaaattgccagccgggtcaatgagatgctcggcctggtgcatatgcaggagttcgccaaacgcaaaccgcatcagctttccggtggtcagcgacaacgtgtggccctggcccgaagccttgcgaagcgcccgaaactattactgctcgatgagccgatgggcgcgctggataaaaagctgcgtgacaggatgcagcttgaagtggtggatattctggagcgcgtcggtgtgacttgtgtgatggtcacccacgatcaggaagaggcgatgaccatggcggggcgcatcgccattatgaatcgtgggaaatttgtccagattggcgaaccggaagagatctacgagcatccgactacccgctatagcgccgaatttattggctcggtaaacgtctttgaaggcgtactcaaagagcgtcaggaagatggcctggtgcttgattcgccggggctggtgcatccactgaaagtcgacgcggatgcctcggtggtcgataacgtgccggtacatgtggcgctgcgcccggaaaaaatcatgctttgcgaagagccgcccgccaatggttgtaacttcgcggtgggggaggtgatacacattgcctatctcggcgatctttcggtgtatcacgttcgtctgaaaagtgggcagatgattagcgcccagctacaaaacgcccatcgtcatcgtaaagggttaccgacctggggcgacgaagtgcgtttgtgctgggaagtggacagctgtgtggtgctgacggtttaaggagcaaagatgagtacacttgaacctgctgcccagtcgaaaccgccgggcggatttaagctgtggttgtcgcagctgcaaatgaagcatgggcgcaaactggtcattgcgttgccatatatctggttgatcttgctgtttctgctgccatttctgattgtctttaaaataagcctggcggagatggcgcgcgctattccaccttataccgaactgatggagtgggctgacgggcaactgtccatcactcttaatctcggtaattttctgcaactgaccgacgatccgctctatttcgatgcttatctccagtcgctacaggtggctgcgatttcgacattttgctgtttactgatcggctatccgctggcgtgggcggtggcgcacagtaagccttcgacccgtaatattttattactactggtgatcctgccgtcgtggacctcgtttctgatccgcgtttatgcctggatgggaatattaaaaaacaacggtgtgctgaataattttctgctgtggctgggggttatcgatcaaccgctgaccattctgcataccaatctggccgtttatatcggcattgtttacgcttacgtgccgtttatggtactgccgatttataccgcgttgattcgtattgattattcgctggtggaagcagcgctggatctcggtgcacgaccgctgaaaacgttctttactgtgatcgtgccgctgactaaaggtgggattattgccggatcgatgctggtgtttatcccggctgtgggcgagtttgtgatcccggaactgctcggtggcccggacagcatcatgatcgggcgcgtgctatggcaagagtttttcaataaccgcgactggccggtggcctcggcggtagcgatcatcatgttgctgctgctaattgtgccgataatgtggttccacaaacaccagcaaaaaagcgtgggagaacacggatgaataatttaccggtagttcgttcgccctggcggattgtgattttgctgctgggctttacctttctctacgcgccaatgctgatgctggttatctattcgtttaacagctcgaagctggtgacggtgtgggccggctggtcaacgcgctggtatggtgagttattgcgcgatgacgcgatgatgagtgcggttggtttaagtctgacaattgcggcctgtgcggcgacggcggcggcgatcctcggaactattgcggcggtggtgctggtgcgctttggcaggtttcgcggatcaaatggctttgcctttatgatcaccgcgccgctggtaatgccagatgtcatcacgggcttgtcgctgttgttattattcgtcgcgcttgctcatgccattggctggcctgcggaccgcggtatgctcaccatctggctggcgcatgtcactttttgtacggcttatgtggcggtcgttatttcttcaagattgcgggaactggatcgctcgatagaagaagcagcgatggatctcggtgcgacgccgctgaaagtgtttttcgtcattacgctaccgatgatcatgcccgcgatcatttctggctggttactggcttttactttgtcgcttgatgatctggtgatcgccagctttgtttccgggccgggagccaccacgttaccgatgctggtcttttccagcgtgcggatgggggtgaatccggaaatcaacgccctggcaacattgatcctcggcgcggtcggaattgtcggatttatcgcctggtatctgatggctcgcgcagaaaaacagcggatacgcgacatccagcgtgcaagacgtggctgaagacactaaaatttgccaacctggctacataatgccgcgcatgtcgcggcattgttttcatggaagacgaaacgttgggattttttaagaaaacatcttcatctcatgctcgcctgaatgtgcctgcgctggtgcaggtggcggcgctcgccattattatgatccgtggcctcgacgtgctgatgattttcaatacgctgggcgtgcgcggtattggcgagttcattcatcgcagcgtacaaacctggagtttaacgctggtctttttaagcagtctggtgctggttttcattgagatctggtgtgcgttttcactggtgaaagggcgtcgctgggcgcgctggctatatctgctgacacaaatcaccgccgcaagttacttgtgggcggcttcgctggggtacggttatccggagctgttcagcattcccggtgaatcaaaacgtgaaatcttccatagcctgatgctgcagaagctgccggatatgctcatcctgatgctgctgttcgttccctcgaccagtcggcggttcttccagttgcaataatgtgtataatcgtcgcccctgatgatgtgaaggtcaatgtatgcagtgcgcactttacgacgcgggtcgctgtcgttcctgtcagtggataatgcagccgattccagagcaactctccgctaaaaccgccgatcttaaaaatctgctcgccgactttccggttgaggaatggtgcgcgccggtgtcaggcccggaacaagggtttcgtaataaagccaaaatggtggtgagtggtagcgttgaaaaaccactgctcggtatgctgcatcgcgatggcacaccagaagacctttgtgactgcccgctttatcctgcctcatttgcgcccgtttttgcggcgctaaaaccgtttatcgcccgagcggggttaacgccctacaacgtggcgcgtaagcgtggcgaactgaaatacattctgctgactgaaagccagagtgatggaggcatgatgctgcgctttgtactgcgttctgataccaagctggcgcaactgcgtaaggcgctgccgtggttacacgaacaactaccgcagctgaaagttattaccgtcaatattcagccggtacatatggcgattatggaaggggagacggagatctacctgaccgaacaacaggcactggcggagcgttttaatgacgtaccgctgtggatccgtccgcaaagtttcttccagactaatccggcggtcgccagccagttgtacgccaccgcgcgcgactgggtacgacagctgccggttaaacatatgtgggatctgttctgcggtgtggggggctttggtttacactgcgcgacgcctgacatgcagttaaccgggatcgaaattgcatcagaggccattgcctgtgcaaagcagtcagccgctgaactgggcttaacgcgtttgcaatttcaggcgctggactccactcagtttgccaccgctcagggggatgtgccggagctggtgctggttaacccgccgcgccgcggcattggtaaaccgctgtgtgattatctctcaacgatggcaccgcgttttatcatctactccagctgtaacgcccaaactatggcgaaagatatccgcgaactgcctgggtttcgtattgaacgggtgcagcttttcgatatgttcccgcataccgcgcactatgaagtgctgacgctgctggtgaagcaataaaaaagccgcatgtgcggcttcagattgctgacaaagtgcgcgttgtttatgccggatgcggcgtaaacgccttatccggcctacaaaagcgtgcaaattcaatacattgcatgggccatgtaggcctgataagcgtagcgcatcaggcaattttacctttgtcatcagtctcaagccgcggttgcggctttctgaatcttactgtgggaaccactggtcactgattttttgataagtaccgtcagctttaattgctgccagcgcgttattcagtttttccagcagggctttgttatccggacgtacagcgatgcccaggccggtgccaaaatattgcggatcggtcactttctcagtagcaacaccaagttgtggattggttttcagccattcgtttaccaccgctgtgtcaccaaataccccatcaatacgaccatttttcagatcgataaaggcattctgataactgtcataagagacagttttcacttccgggtgctgatcctgaatatatttctggtgcgtagtaccgttttccatcccaatacgtttgcctttcagatcggcaaacgttttgtaggtatcttttttggcaatcacgacggctgagttttcatagtagggcgtggtaaacgatacctgtttgctacgctccggggtgatatccataccggagattacggcgtcatattttctgaatttcagggacgggatcaggctgtcgaacgcgtgattagtaaaagtacattctgcctgcatttgtttgcacaaggcttttgccagatcgatatcaaagccgacaatctcattattagcacctatagattcaaagggtggataggtggctgaaacgccaaaattgattttctctgcggcagaagcaccgaaagtaaaggaagcaagtaaagcggcaagaactaactttttcatgatggaactcccgtctgtcaatcttatgatttttggccgtgtctgcggcatgggataacaatgccatcaagtgaatttatatgcaataaacatgattaaataatttaaatgaaataaaaaagacggacaacttagtgggttgtccgtcttcattataagaatttatgcactatgtaggccggataaggcgtccccgccgcatccggcacaggcaccgtgctgatgtctgatgcgacgctggcgcgtcttatcagacctacaaaaccccccggcgaatgtacgcagccacattaatttcgccgttcgaatgccagcgctttgcgctcgatcagacgcatcatcagcgtcagcaggccgttaacgaccaggtaaataatccctgccgcaccgaacaccattacatcgtaggtgcgtccgtacaacaactggctgtatcccatcacttccatcagcgtaatggtgtatgccagagaggtacttttgaataccagcaccacttcgttggaataagaagagagcgagcgtttaaaggcatacggcagcaggatcgccagcgtatcttttttgctcattcccagggcgctacaggactgccactgaccttccgggatcgcacgaattgcaccgtaaaacagctgcgtggtatacgccgcactattcagcgacaacgcaatcagcgcacataaccacggttctgacaacaaatgccacagtgccggatactcctgcaaagtcggaaactggcccggcccgtaataaatcaggaagatctgcaccagcagcggcgtaccggtaaacagcgtgatataaccccgcaccagccacaccagcaccggcgttttcagcgtcaggatgatggtaaaaatcaatgccagaatcagtgccacaatcagcgaggcaacggttagcgtcaggctggtgtgtagccctttcatcagttcgggtaaatactcaaacattagctgggcctccgctcaaaacgtgtcgcgcgcaggtcaatgcgtttgagaatgtactgactgagcagggtgatcaccaggtaaatcgccgccgccacaatgtaccaggtaaatggttcctgggtacgagtagcgatgctttttgtttgcagcattaaatcattcacactaatcaaactgaccagcgcggtatctttcagcagcaccagccactggttaccgaggccaggcagcgcatgacgccacatctgcggcatcaccagacggaaaaagatagccgatttcgacagccccagcgcctgaccagactcccactgacccaccggcaccgctttcaacgcgccccgaagcgtttgcgaggcataggcggcatacagcagtgacagagcgatgacaccacaaaggaacgggctaacgtcgaagttctcaatgtccatctgcactgggatctgcacgaacccaagattgatagtgaagccatccgaaagcgtcagcagcagctgcgaggagccaaaatagataaacagcaccaccagaatttctggcaggccacgcagaatggttaccagcgctgaacctgcccacgcgacaggacgccattttgccgactcccataccgcaaagaacatcgccagcgccagcccgacaatcaatgcacaaacggcaaggccgacggtcatcccggcggcgcttgctaaaggaaaaaattcattcatcaggaattacttctggaaccatttgttgtagatggtttcgtaagtgccatctttcttcactttttccagcgcagtgttgagtttctgctgcagctcagtgttgccctgacgtaccgcgatgccgaggccagtgccgaagtaatctttatcggtcactttgtcgcccaccgccgccagtttcgggttatctttcagccactcagtgaccactgcggtgtcaccgaagacgccgtcgatacgcccgttttgcagatccagttttgcgttctggtagctgtcatacggaacggtagtgatttccgggtgcttatccataatgaatttctggtgtgtcgtcccgttctgtacgccgacttttttgcctttcagctgatcaacactggtgtatttgccttgctgacccacaaacagggcagagttgtcatagtacggggtggtaaacagcacctgcttttcacgctccggagtgatatccatgcccgccatcacggcttctacgcgacggaatttcaggcttgggatcaggctgtcaaacgcctggttagagaaagtgcaggttgcatcaatctctttacacagcgcttgtgccaggtcgacgtcaaaaccaacgatctggttgtttgcatcaatcgattcaaacggaggataggaggcttcggtagcaaaacgaatggtttcggcagctgtggcggaaagactaaaacctgcaattaacgcggcaatcagaacttttttcattgttgttatcccgaatcttagtgagagagatagtttttaaatgcttcggtttgcggctcggtaaagcagctcgcgtcgccttgttctacgatatgaccattttccatatacaccactcggctggcggttttacgcgccacttcaacttcgtgggtgacgatcacctgggtaatattcgtttctgccagctcacgaatgatgctgacgatttgtgccgtaatttccgggtccagtgcggcggtcggttcatcgaacagcagtacctgcggttccatcatcaacgcacgggcaatagcaacacgctgctgctgaccaccagaaagatgcagcgggtaacgatcgctataaggtttgagacgcagacgttccagcagtttttctgcacgggccagcgcctgatctttactcaaccccagtacacggcagggcgcttcaatcaggttttgctgcacggtcagatgcggccacaggttgtattgctgaaacaccatgccaacgttacgacgcaaatcgcgaatcgctttgtcagagggtgttttggtgaaatcgaaatggttgcctgcaatgttgagcgtaccggagcgcggcatctcaagcagattgagtacacgcagcagcgagcttttacccgcgccgctggggccaagtaacaccagcgtttcgccctgtgggcaatccagcgtgatatcgaacagcgcctgatgcgcgccgtagaagcaattaatgccgtttaattgaatactcattgacactcgtatactggcagtctgatagctattgaggtcgaagatagtacctttgacagaataattatgcaatatttctgctttaaaagttaaaagcaaagcgcattattcaataaacatagcacaaaataacgggggcggtggtcggcgagcataaatgtcggcattcctcacgaaatgccggacaatttacggggtttattggttgatcaaggcgttagcgattctcgatggactgacggagcgtacccgccgtggcatgaacgctaccgcctaagtaacgcacatcgtcgatgacccaacactggccttcctgaatcattaacacttcatcctgccaaccctggtcaccctgtttgagatccacgcgcaatggaatgttacgggcatcacgattagggatagtcgatgcactggcaacgtgggcgctatctggcaaggtggttcgactggagaatggatcgttggtcagtagttcccgatggttattatcccgggaggcatcgctaagcagtgtcgccagtttgtcgctcagataagggcgcaaggcggtgatgtcgttgctgcggtgcaaaatgcggtagtcataaaattgctgggccacgttatccgggcctccttcaacgcaaggaccactgcgtgtgccgttatctttataagctggagtgactgtggtgcaggcactgaggagcagtgcgcaggggataagcattgtcaatttgctgtagcgcataatgatttccttataagcgatcgctctgaaagcgttctacgataataatgatatcctttcaataatagcgtatcagtctgataatgcttttgagatcgaaggcttagcaaacaaggagatcgatcatgcaattttctacaaccccaactctggaaggccagaccatcgttgaatattgcggtgtggtgaccggcgaagcgattttaggtgccaatattttccgtgatttctttgccggtatccgcgatatcgttggcggacgttccggtgcgtatgaaaaagaactgcgtaaagcacgggagatcgcctttgaggaattaggctcccaggcgcgggcgctgggggccgatgccgtcgtcggtattgatatcgactacgaaacggtcgggcaaaacggcagtatgctgatggttagcgtcagcggtacggcggtgaaaacgcgtcgatgagaagattcttctggctggtcgctgccgctctgttattggcagggtgtgcaggcgaaaaaggcattgtcgagaaagagggatatcagcttgatacccgacgccaggcgcaggcggcgtatccgcgcattaaagtgctggtgatccactacaccgcagatgattttgatagctcgctggcgacactgaccgataagcaggtcagctcgcattatctggtccctgcggtaccaccgcgatacaacggtaaaccgcgcatctggcaactggtgccggaacaagaactggcctggcatgcggggattagcgcctggcgcggggcaacgcgccttaacgacacctctattggcattgagctggaaaaccgtggctggcaaaaatcggccggagtgaaatattttgccccgtttgaaccggcacagattcaggcgcttattccactggcgaaagatattattgcccgttatcacatcaagccggaaaacgtagtggcacatgcggatatcgcaccgcagcgcaaagacgatccggggccattatttccctggcagcaactggcgcagcaggggattggtgcctggccggatgcgcagcgggttaacttttaccttgccgggcgcgcgccgcacacaccggtagataccgcgtcattgctggagcttttggcgcgctacggttatgacgttaaacctgatatgacaccgcgcgagcagcggcgcgtgattatggcattccagatgcatttccgcccgacgttatataacggcgaagcggatgcagaaactcaggcgattgccgaagcattgctggagaaatacgggcaggattagcgcggcagttttccgtggtcgcgtagccaggcggcagttttctcgataccttcatccagggtgatgaccggctgataacctaactcttcctgcgcacgcgtaatatccagcgtaaagtcaaaattcaacttggagacgccgtagtgggtcagcggcggctcttttgctgacttgcggcctaaacgctccatgctgcgggcgatcatatccagcatcgggtaggggacggaacgaatacgacagtcaatattcaactcgtcgatcagcttctgcacgatgctgcgcagtgtgcgatgctcgccgttggtgatgttgtacacacgcccggaaggtagcttatcgcaggcttcctggcttgccagccacattgcgtgcacggcattttcatagtaggtcatatcgaccagcgcactgccgccatgcggtaacagaatactgccgtagtggtgcatcatatgcgccagacggggaataaagactttatcgtgcggtccgaacagactttgtgggcgcagaatagtaaagcgcgtttgtggattcgcctgcgaaagcatattgatcacttcttcgctggctgctttgctgcgggcaaactcgttggcgaagcggtgagggcgaaaatcttctttaatatcgcgatggtggtgataatcgaagtacagggagggggaagagatatgaataaagttacgcacaccccaggcgacagcccattcacccaggcggcgagtggcgcgaacgttagccagatcgaaagcctgttgtgtcccccagggtgaggtaaagctggagcagtgccacagcgtatcaatgcccgcgagcatcactttagcttgtgatgaaaccagctcggtcagatccgccggaacaaactctgcgcccattttttccagcaatttgcccattgcctcgttgcgaccggtcgctcgcacgctgatgcctttctggcataaaaactctaccgcgtttcgacctaagccgctggtggcgccggtaaccagtaccttcatatcaatccactgttgttgagaaaataacgtgcgcattcttccgtgatttcccccatgatgcaatgggaaacatgaaagaataacgcaggttttgtcgattaatctgtgctttgttctgccagtctggcgatttgttttgccattccgcgaaaaataaacagatgcgcggggatcatcaataaccagtaaaacagccccggcataccgtgcggatgccagaaagcgcggacatcgatagtacgatagtcgcctttatcttccaggctaaaacacagtcgtcccagccccggcgctttcatgccaaataacaacgtaagttgtttttccggttcaacgacaatcactttccagctatccaccgcatcgccagtctgtaaatattcgcgctccgggcggcctttcgccagcttatgaccgatcgcgcggtccatcaacgcccgtgtctgccacaaaatattgccaaagaaataacgctctttaccgccgatttggttcactacctgccataaagcagcaaggctggcggacgttttaacggtaaaccccgcctgtttggcaaaataaccgtactccggtcgccagcgggcaaaggcctgagcgtcgtagccccagtcgctggagttgaccagtttttcctcctctttcaacgtgctacgtaccgcgtcatcgaaagcgatcagccgttgtgggatgagtgcacgtagcgcggtatcatccgccagcagatcgtgtttcagcccctgaatcaacgccctggcggtggtgggcggtacggaagtaatcacattgagaaaccacaccgaaatccagcgggtggggagggggatggggatcaaccagcggcgcttaccgctcaccgccataaaatgttcaaactgttgctgataactgagcacctctggtccggcggcttcgaagatgcggtgttcgctggccggatgatctaacaacgcaaccagatagtgcagcaagttttccagcgcaatgggcgtggtgcgtgaacgaacccagcgcggaggcgttaagactggcaggttgtagaccatatcgcgcatgacttcgaacgccgcggaacctgcgccaacgataattccggcccgcagttcggtcacgggtacattcgcttcacgcagaatgtccgccgtagcctgacgagcacgcagatgatccgactgctcatgtggcggggcctgcaacgaactaagaaagattaattgcttaactggtacttcacgtagcgcatcgcggacgttgagagccacctggcgctcctgagcgataaaatcgccgccttcgcccatgctgtgcaccagaaaatagaccgtatcgatatcctgcaacagggccggtaggttatccggccagctgagatcgactttatggcaactgacgtttgccagttgcagctttgcaagcctgtcgacatgacgtgccgccgccaggatctgatgcccttgctggctgagtgtgcgcaccagatgctgaccaatgtagccactggcaccgagaactaaaatgcgttgcggcacgtctctctccttaacgcgccaggaatgcacgccagtgggcggcgacttccgccagttgttcgcgcgagacgtcaagatgcgtcaccaggcggacaatcggcgaggcgttaatcagcacgtttctcgctttcatgtattcgcctaacgcggcagcattttcttccccgacgcgaacaaacagcatattggtgtcctgacgcatcacatccgcgcctgcttcacgcagctgctccgccatccaggcagcgttgtcgtggtcttcctgcaagcgcgcaacgttatttttcagggcatatatcccggcggcagccagaatgccggactggcgcatcccgccacctgtcattttccgccagcgaatggcacgtttaatgtaatcacgattaccgacgagtaatgaaccgactggcgtcccaagacctttcgacaggcaaatggtgaacgaatcacaatattgcgtgatctctttcagttcgcagccgtaagccaccacggcattaaagatgcgcgcaccgtcaacatgcagcgccagattgcgctcgcgggtaaattcccatgcttctttcaggtattcccgcggcaacactttgccgttgtgggtgttttccagactgagtaatttggtgcgggcgaaatggatatcgtcgggtttgattttcatcgccactttatccagcggtagcgtgccgtcggcagccgcgtctatgggttgcggttgaatactgcccagcaccgccgcgccaccggcttcaaacagatagttatgcgcggcctgaccgacaatatactcttcgccgcgttcgcagtgactgagcagagcgaccaggttggcctgagtgccggtaggcagaaaaatggcggcttctttaccggaaagctctgctgcgtagtcctgcagagcattaacggtagggtcgtctccgtaaacgtcgtccccaaccggggcggccatcatcgcttcgagcatggcgcggcttggtcgggtaacggtatcactgcgtaaatcaatcatggcatgtccttattatgacgggaaatgccaccctttttaccttagccagtttgttttcgccagttcgatcacttcatcaccgcgtccgctgatgattgcgcgcagcatatacaggctgaaacctttggcctgttcgagtttgatctgcggtggaatggctaactcttctttggcgaccaccacatccaccaacaccggaccgtcgatggagaaggcgcgttgcagggcttcatcaacttcagacgctttttctacacggatacccgtaatgccgcacgcttcggcaatgcgggcaaagtttgtgtcgtgtagttcggtgccgtcagtcaaatagccaccagctttcatctccatcgccacaaagcccagcacgctgttgttaaagacgacaattttcactggcagtttcatctgcactactgagaggaaatcgcccatcaacatgctaaaaccgccatcgccgcacatggcgaccacctgacgttctggctctgtcgcctgcgcacccagcgcctgcggcatggcgttagccatcgaaccgtggttaaacgaacctaacaggcgacgcttgccgttcatttttagataacgtgccgcccacaccgttggcgtaccaacgtcacaggtgaaaatagcgtcatcggcggcaaaatgactaatttgctgcgccagatattgcgggtgaatggctttctcgctcggtttagctaaatcgtccagccctttgcgggcgtcgcggtaatcttccagcgctttatccagaaacttgcgatcggctttttcttccaccaatggaagcaatgcacgcagagtcgacttgatatcgccgaccagtgccatatccaccttgctgtgagcgccgatgctggctgggttgatatcaatctgaatgattttggcatcggtcgggtagaaggcgcggtagggaaattgcgtgccgagtagcactaacgtgtcggcgttcatcatggtatggaaacctgacgagaagccgattaacccggtcattccaacatcatacggattatcgtattcgacatgttctttaccgcgcagggcatgaacaataggcgctttaattttcccggcaaactcaactaactctttatgcgcccccgcgcagccgctgccacacatcagggcgatattgctggaataacgcagcagttgcgccagtttgcgtaactcttcttcttccggcgtcacgactggttgtggcgcatgataccagtgcatggttgccccttctggcgcaggttttaacgccacgtcgcctggtaacacgacaaccgaaacgccacggttaagcaccgctttgcgcatggcaatcgccagtacttgtgggatctgctccgggctggaaaccagctcgcaatagtgactacattcgcggaatagctcttgtgggtgggtttcctggaaatagccgctgccaatttcgctggagggaatatgagcggcaatcgccagtaccggaacgtgattgcggtggcaatcgaacaggccgttgattaagtgcaggttgccggggccgcacgatccggcgcagaccgccagttctccgctaagttgtgcttcagcgccagcggcaaaggccgccacttcttcgtggcgggtggacatccactcgatggtgcccatgcgattaagactgtcactaagaccgttcagagagtcgcctgtgactccccagatgcgtttcacccctgccgattcgagtgttttggcgatataagctgcaaccgtttgtttcatggttctccatctcctgaatgtgataacggtaacaagtttagttcatctgacggagggggaagggatgggagagaaaggaggcactaacggttaaatagcccgatgaaaggaatatcatcgggcataaggcgattatgcgagaaccaaatccccctgcggatggcaggagcaggccagtacgtaaccttcagcgatttcggcgtcggtcagcgtcattgtgctgctcaccgtatattcaccggaaaccacttttgtcttacagcagccgcaaacacccgcacggcaggcagcgacaaccggaacgttattgctttccagcgcctccagtagcgtggtgccaaccggggcgtaaaattctcgtgccggttgcagtttggtgaatttcagaccgctggtcgccgcttctgctactggggtgaagaatttctctttaaagaaacgcgtcacgccgagcgctttcacttcctgctctacccaatccatatacggagccgggccgcaggtcatcacggtacgtgaagctaagtcaggtacacctgccagcagttcgcgagtgagacgaccagcgataaagccttcggtaacgttattttctgccaccagcgttaccggatagttacgccactcatcggcgaaaataacatcctgcggcgtacgcacgttgtagatcacccgcacatcggcctgtggacggttcttcgcaagccagcgacgcatcgacataatcggcgtgacgccgcagcctgccgccagcaacaggaatttatcttctgctttatcgtcgcaggtaaattcccccatcgcgtccgaaagccagagataatcaccgcgttttacatcgcgcgtcagccactgggagccgacaccgtcatcaatccgccgcacggtcagggtgatatattcactcacgcctggcgtggaggaaatggtgtaagcacgcagcgtttccgctgagtttcgcacgctgaccagtgcatattgcccggcgcgatatgggtagtaatcgtggcaaatcagggaaatcgtccacacatccggcgtttcttgcgtaatgtgatgaacctgcatccgccacgggcattgattcgttggcatcgtcatcgacaaactccttacgcgctcaacagttgcttcatgtcttcttcaacagtggtgatagaacgcaggccgaatttctcgttcagcaccgccagcaggtctggtgtcaggaaaccaggtgcagtcgggccggtgacgatatttttcacgcccagagaaagcagcgtcagcagaatgacgatcgctttctgttcaaaccaggagagcaccagcgacagcggcagatcgttgacaccgcagcccagtttctctgccagagtgacagccagaataatcgctgagtaagcatcgttacattgacctgcatctaccagacgcggcagaccttcgatatcgccaaactcaagtttgttaaagcgatatttaccacaggcgagggtcaggatcaggcagtcatccggcacgctggtggcgaaatcggtgaagtagtggcgctcgccgcgtgcgccgtcacagccaccaagcaggaagatatgacgcagtttttcacggctcaccagatcaatcagcgtatcagcagcgccaagcagcgtctggcgaccaaaacccacggtgataaggtgcggaatttcgctgtacgggaagcctgccatctgttgcgcctgggtgataaccgcagagaaatcatcaccgtccagatgacgcacgccaggccagccaacaatgctgcgggtccagatacgatcgtcataagcgcctacggttgggtcgatgatgcagttcgaggtcatcacgatggggccagggaaacgagcgaactccacttgctgattctgccagccgctgccgtagttaccgaccagatgcttgaatttacgcagctccgggtagccatgcgcaggcagcatttcgccgtgggtgtagacattaacgcccgtgccttcggtctgttccagcaggttgtagagatctttgagatcgtgaccggaaatcagaatgcatttacccgccgtcgctttgacgttgacctgggttggcgtcgggtgaccgtatttaccggtttcgcctgcatccagaatgctcatcactttgaagttcatctggccgatttccattgaacactcaagaagcgcgttcatatcggcaggccaggtccccagccacgccatgattttatggtactgggcataaatatcgttgtcgtattgaccgagaacatgcgcgtgttccatataggccgccgcacctttcaggccatacaggcacagcagacgcaggccgagaatgttttcgccaatcgccgctttatctttgttaggggtaaattctgctgcctgacgttgcagctcgccgagatcgtcgctcaccagttgcaggtcagccatcgggttatcgacgcgcgcgttggcatctacagccaggcattgcgctttcagcgcctcgcgcagggcaatcgcttcacgagcgtagccgacaatacgcggagaatcgaagttaacgttggtcagggttgagaaaaaggcacgtggcgcgaagctgtcaacatcgtggttgatgatgccgtattcacgcgcttttaccgcccaggcagaaagcccttgcagcgccgcgatgagtaaatcctgaaggtcagaagtttccgccgttttaccacacatcccctgcgcgtatgagcagccgtttcctgccggagtacggatagtttgttcacattgcacacaaaacatgatcacaccttttaaagttatatttaatatacatgtttaaggttaagacgcttaacgcggggataaaagggatttttcatgcaactttaagggagattgatttagcgcaattttggcggcagggatctaccgccagagaggtattacgcagagaaaaaggcgatgaggatcggcactaacaggctaagaataaaaccgtgaacaattgccgccgggaccatatccagcccgccagtacgttgaagaacgggcagggtgaaatccattgatgtggcaccgcataagcccagtgcagtagagcggctgcggcgaatcagcccagggatcaacataatagcaatcagttcacgggccagatcattaaaaaacgccgcgctcccgattaccggaccaaaagattcggtcaataaaataccggaaagagaataccagccgaaaccggaggccattgccagcgcggtattgatggggagatcaagaataaaggcgttaattaaaccaccaattaatgaactgacaaccaccaccacggcgacaatcattccccggcgattaaggacaatctgctttaaggtcatgccattattgcgcaactgaataccaacgaggaaaagtagcaaaattaacgtgtattcactggcttcggtcgcgtgttgtaagaaagccagtccacttagaccaatggcaaaaccaatcactactacgccgcacagttttagcgactccagcgccatcgcaatacgcgacgggagtttttcttgctgatggtggttgcgccacggcaggcctcgctccagccacatcagggcggcaatattacacagtaaaataacggtaatactgacggcagaataatgcagaatcgccaacaggttactggcgaggttatcgagaaacgccagactgatacccataaaaaagagaataaggtaaaccatccagcttaatagctgattaataacttttaacgcagcttgttggcgaagcggaatgaggtaacccacaatcaggggaaccagaatgattaacagcccagaaaacatgaaaacccagtccttgcaaagatgaagtcgaaatgcgcgatgacacactactgaaagcggaaggacgagtaaagttgcaattaaaaggaaatgttatgcataaggagcagtagagtattcgttttcatttaaagatattcttgcgctttaattacaaactgcaccgatgttggtggcgtcaaaatcgccgaggcgttccctgaaggccggggcagcccacatggatgtgggctgagggcgcgttttacagggatgttacctcgcgcccgacccggtagccgtaagggataagtcgagggcaccgcgcagcggcgattttgttcgccagagcccgggggtgcagggggcggcggcgattggccgccccctgcgcgctccttgcgccagtggcaatatgttgcttagctcatgaaaggagcgcaacaagatgatgaatcaacatataacaacatcttaaaaaaaggcctgacattacgccaggccttctgcgttaattaatcacgcttttccagcagggtccggtaaatcagaccaccgataatgccgccgacaattggcaccacccagaagaaccacagttgttctaatgcccagccgccctggaagatagcaaccgcggtgctgcgcgccgggttaacagaagtgttagtcaccggaatactaattaagtgaatcagggttaaggccagaccaatagcgatcggcgcaaaacctgccggcgcgaatttgtcggttgcgccgtggatcaccaacaggaaacctgcactcaataccagttcaactaccagcgcggaaagcatggaataaccgcctggtgaatgctcgccataaccgttagaagcaaaaccgctggctgccgcgtcaaaacccgttttaccactggcaattaaatacagcagcgccgctgcaacaataccgccgacaacctgggcaattacgtagccaacgacttcttttgccggaaaacgtccgccagcccataaaccaatagtgaccgccgggttaaaatgaccaccagaaatatgaccaacagcaaaggccatcgtcagaacggtcagaccgaacgccaacgccacgccggcaaaaccaatgcctaattccgggaagcctgcggccagtacagcactaccacagccaccaaaaacaagccagaaagtaccaaaacattcagctgctaattttctgaacatatccaccacaattaaaaattgaccctgtgaaaaatatggtcgttttatagggtcgtcgtaaaaaagtgacgacggaaataatgcgcggctattttaaaaacgaaggcgagtcattcaccagataaataaatccagtaaatttgatttagggcaacagcgggttgccccatatagtcatttgtctgattgacagtgtagtgcacgcaaaagatttaatcctttaggcgtaataaaaaataatttatcatgctaattatttgattttgttgtttttgcagacttatcagcaagagggagtataacgcgattattcgctcatttttcagacatttgccatgcttaaatgtgatgtcatcacgtattagcaaggcctttcccgttatactgccagcgtaaaggataagtcacatatttctggaggggatatgattcttgagcgcgttgaaattgtgggttttcgcggtatcaaccgtttgtcgttgatgctggaacaaaacaacgtcctgattggggagaacgcgtggggtaaatccagcttgctggacgccttaactctgctgctatcgccagaatcagatctctaccattttgagcgcgacgatttctggttcccgccgggagatatcaacgggcgagaacatcatctgcatattattttgaccttccgcgaatcgctgccaggccgacatcgggttcgccgttatcggccgctggaagcgtgctggacgccatgcaccgatggctatcaccgtattttttatcgtctggaaggggagagtgcggaagacggcagcgtgatgacactgcgcagttttctcgataaagacggacatccgattgatgtcgaggatattaacgatcaggcacgccatctggtgcgtttaatgccggtgctgcgcttgcgtgatgcccgttttatgcgccgtattcgtaacggcacggtgccaaatgtccctaatgtggaagtcaccgcgcgccagctcgatttcctcgcccgtgagttatcctcacatccgcaaaatctctctgatgggcagattcgtcagggactttccgcaatggtacagctgcttgagcattatttctctgagcagggggccggacaggcgcgatatcgtttaatgcggcggcgagccagcaatgagcaacgaagctggcgctatctggatatcatcaaccggatgattgaccgacctggtgggcgctcgtatcgggttattttgctcggcctatttgctactttgttgcaggcaaaaggcacattgcgactggataaagacgcccgtccattgttgctgatcgaagatccagaaacccgtttacaccccattatgctttcagttgcctggcatctgttgaatcttctgccattgcagcgcattgccaccaccaactcgggtgagttgctttcgttaacgccggtagagcatgtttgccgactggtacgtgagtcctcgcgcgttgccgcctggcgtctggggccgagtggcttgagtaccgaagatagccgacgcatatcctttcacattcgttttaaccgtccgtcatcgctgtttgcacgctgctggttgctggtggaaggggaaacggaaacctgggttatcaatgaactggcgcgtcagtgcggacatcattttgatgccgaagggatcaaggtcattgagtttgcccagtccgggctaaagccactggttaaatttgcccgccgaatggggattgaatggcatgtactggtcgatggcgatgaagcagggaagaaatatgccgctacggtacgcagcctgttgaataacgatcgggaagccgaacgagaacatttaacggcgttaccggcgctggatatggaacattttatgtatcgccagggattttccgatgtgttccaccgcatggcgcaaatcccggaaaatgtaccgatgaatctacgcaaaattatctcgaaagcgatccatcgctcttccaaacccgatcttgccattgaagtggcaatggaggcaggacgtcgtggtgtggactccgtaccgacgctgctgaaaaaaatgttctcacgcgtgctgtggctggcgcgcggtcgcgcggattaaccgcgaaacatcgtggccatttgtggctgaatagcgtcgagcatctcatagcgccgacggtattcagcccgttttttactggcgatttcggcaatctcttttcgtgctatctgtgctggaaggcggtaatggcgttcagcatcacatacgccgccaaccgattcccagaaagcgttgtaatcagcgtggatcttgccttctttatcgcgataacgcaggctgcggtaaatatgcgtttcattgctgacggcaataatctgctctacctgcaaacgttgggcaaacagacaggccgcttccatcacgaggcgtttgggaaatagcccgtggcaggctttcgtcgcattctggatttcctgatgtggaatttcccattttgcgccttgcagtccgccaataaacatcgttcttttcccctgatattcacacagggtaaacgtgatctctgccagaggaataccttcgctgttgcggaacaggattgtgctgtcaccttctttatccattgagatcatcatggtcagctcaagcgtgaactgctcgccgtttttgccttccagcttcgccagttgcagcccgggggtattcaaatataagctgaattcttccgccgacatacattcgcggagtaacgcataatggtaacgtaacgcctccagcaattgcttacggctaagattcgccgcaaggtaagggcgatgcagacgcacaggcagtcgcggctggcgcgttaacaatacattgagattaggccagtgggaaagttcgttcatccactcaacgcttaaacgcggcataatcaacgagcgcagcaaaaatttctggcgaaaactacggcgatgccagaatttacccggccgacactgtccacgtgccagactaagaaaaagtgacaggctgctgagagattcagatggcgtaaaggtccgttcagttagctgcgacatattcatgaaatcaatggttatacatggcgtcgatttcaccattgcgtatcttaaccaaacatcaatagtgtgattactaacgtaaattttagggttttgttgatatttcgttgaagttaatgacccggattggcatatggagtattcagaaaatttatgaaaaagcggaaaaccgtgaagaagcgttacgttattgcgctggtgatagtcatcgccggactgattacgttatggagaattcttaacgcacccgtgccgacttatcagacgctgattgtgcgccccggtgatttacagcaaagcgtgctggcgaccggaaagctggacgcgctgcgtaaggttgatgtgggcgcgcaggtcagcggtcagttgaaaactctgtcggtggcgattggcgataaagtaaaaaaagaccagcttttaggggttattgatcctgaacaggctgaaaaccagattaaggaggtcgaagcaacgctgatggagctacgtgcgcagcggcagcaggcggaagcggagctgaaactggcgcgggtgacgtattcccgtcagcaacgtctggcacaaacgaaggctgtttcacagcaggatctcgacaccgccgcgacggagatggctgtgaaacaggcgcaaattggcaccattgacgcgcaaatcaagcgcaatcaggcttctctcgatacggctaaaaccaatctcgattacactcgcatcgttgccccgatggccggggaagtcacgcaaatcaccactctgcaaggccagacggtgattgccgcacaacaagcaccgaacattctgacgctggcagatatgagcgccatgctggtaaaagcgcaggtttctgaagcggatgtaatccacctgaagccggggcaaaaagcctggtttacggtgcttggcgatccactgacgcgctacgaggggcaaatcaaggatgtactaccgacgccggaaaaggttaacgacgctattttctattacgcccgttttgaagtccccaaccccaatggtttgctgcggctggatatgactgcgcaagtgcatattcagctcaccgatgtgaaaaatgtgctgacgatccctctgtcggcgttaggcgatccggttggcgataatcgttataaagtcaaattgttgcgtaatggtgaaacacgcgagcgtgaagtgacgattggcgcacgtaacgataccgatgttgagattgtcaaagggcttgaagcgggcgatgaagtggtgattggtgaggccaaaccaggagctgcacaatgacgcctttgctcgaattaaaggatattcgtcgcagctatcctgccggtgatgagcaggttgaggtgctgaagggcatcagcctcgatatttatgcgggtgagatggtcgcgattgttggcgcttcgggttccggtaaatcgaccctgatgaatattctcggctgtctggataaggccaccagcggcacctatcgcgtcgccggtcaggatgttgccacgctggacgccgatgcgctggcgcaactgcgccgcgagcatttcggctttattttccagcgttaccatttgctttcgcatttaaccgccgagcagaacgttgaagtacccgccgtctatgctggtcttgagcggaaacagcgactgcttcgtgcccaggagttgctgcaacggctggggctggaagaccgtacagagtattatccggcacagctttcgggtggtcagcaacagcgcgtcagcatcgcgcgggcattgatgaacggtggtcaggtaattcttgccgatgaaccaaccggcgcactggacagccattctggcgaagaggtgatggcgatcctgcatcagctgcgcgatcgtgggcatacggtgattatcgtcacccacgatccgcaggtcgctgctcaggccgagcgggtgatcgaaattcgcgacggcgaaattgtgcgcaatcctcccgccattgaaaaagtgaatgttactggcgggacggaacctgttgtcaacacggtgtctggctggcggcagtttgtcagcggttttaacgaggcgctgacgatggcatggcgggcgctggcagcgaataaaatgcgtactttactgaccatgctggggattattatcggtattgcgtcggtggtttccattgtcgtggtgggtgacgccgccaaacaaatggtgctggcggatattcgttctattggtacgaatactattgatgtctatcccgggaaagattttggcgatgacgatccgcaatatcagcaggcgctgaagtacgacgacttaatcgccatccaaaaacaaccgtgggtcgcctcagccacacctgccgtctcgcaaaacctgcgcctgcgttataacaatgttgatgttgctgccagtgccaatggcgtgagcggcgattattttaatgtctatggcatgaccttcagtgaaggaaacacctttaatcaggagcagctgaacggtcgtgcgcaggtcgtggttctcgacagtaatactcgccgccagcttttcccccataaagcagatgtggttggcgaggtgattctggtcggcaatatgcccgccagagtcattggtgtggcggaagaaaaacagtcgatgtttggtagcagtaaagtgctgcgtgtctggctaccttacagcacgatgtccgggcgagttatgggccagtcgtggcttaactccattactgtcagggtgaaagaaggatttgacagcgccgaggcggaacagcaactcacgcgtttactttcactgcgccacggaaagaaggatttctttacctggaacatggacggcgtcttgaaaactgttgaaaagaccacacgtactttacaactgtttctgacgctggtggcggtgatttcgctggtggtgggcggtattggtgtaatgaatattatgctggtgtcagtgaccgagcggacgcgggaaattggcattcgcatggctgtaggtgcgcgagcaagcgatgttttgcaacagttcctgatcgaagccgtactggtttgcctggtcggtggcgcgttgggaataacactgtcactgttaattgctttcaccttgcagcttttcttacccggctgggagattggtttttcaccgttggcgctgctgctggcgtttctctgctcgacggtcaccgggattttatttggctggttacccgcacgaaatgcggcacgactggatccagtagatgctctggcacgagagtaatttttgagataaaaatgccagccgatcgggctggcattttgcctttaggatgtacacaatgagacagaagagctatgcgactgccgcttctacttcgacgggcacaataacactggcgtgattgccttttggcccctggtggacatcaaactgaacggattgtccagcttttagcgttctgtaaccatccatctgaatggtggaataatgagcgaaaatatcttcgccgccgccttcagggcagatgaaaccaaaccctttggcattgttgaaccacttaacagtacccttttccatgcttcgacatccttcgcaaatcttatacaagtaagatggaataaaccggggtcagagagggggctgttcaaaacctcgccaactctagaaatacaatttagagaattagggcgagccgtcaagcatttgacaggggacaaggggcaggtatgaatcaaaaatttgaagcagttaacgctattgacaggaatgtgacagatgtcgctgatgccaacgatagatgatagttatctatcatgtggagtagattggtcaggcaaataagctcttgtcagcggcagggcgttctgccgataaccgtaaccgaagatgataactgacaatgggtaaaacgaacgactggctggactttgatcaactggcggaagaaaaagttcgcgacgcgctaaaaccgccatctatgtataaagtgatattagtcaatgatgattacactccgatggagtttgttattgacgtgttacaaaaattcttttcttatgatgtagaacgtgcaacgcaattgatgctcgctgttcactaccaggggaaggccatttgcggagtctttaccgccgaggttgcagaaaccaaagtggcgatggtgaacaagtacgcgagggagaatgagcatccattgctgtgtacgctagaaaaagcctgaatgcaggcataaaaattgggggaggtgcctatgctcaatcaagaactggaactcagtttaaatatggctttcgccagagcgcgcgagcaccgtcatgagtttatgaccgtcgagcacttgttactggcgctgctcagtaacccatctgcccgggaggcgctggaagcgtgttctgtggatttggttgcgctccgtcaggaactggaagcctttattgaacaaaccacacccgttctgcctgccagtgaagaggagcgcgacacacagccgacgctgagttttcagcgtgtactgcaacgtgcggtcttccatgtccagtcctccggtcgcaatgaggttaccggtgcaaacgttctggtcgctatctttagcgaacaggagtcgcaggcggcatatctgttgcgtaaacatgaagtcagccgtctcgatgtggtgaactttatctctcatggcacgcgtaaagacgagccgacacagtcttctgatcctggcagccagccaaacagcgaagaacaagctggtggggaggaacgtatggagaatttcacgacgaacctgaatcagcttgcgcgcgtgggcggaatcgacccactgattggtcgtgagaaggagctggagcgtgctattcaggttctctgccgtcgccgtaaaaacaacccgctgctggtgggggaatctggtgtcggtaaaaccgcgattgcggaaggtcttgcctggcgaattgttcagggcgatgtgccggaagtgatggctgactgtacgatttactctctcgatatcggttctctgttagcgggcacaaaatatcgcggcgactttgaaaaacgttttaaagcgttgctcaagcagctggagcaggacactaacagcatcctgtttattgatgagatccacaccattatcggtgcgggtgcagcgtctggtggtcaggtcgatgcggctaacctaatcaaaccgttgctctccagcggtaaaattcgtgtaattggttcgacaacctatcaggagttcagcaacattttcgagaaagaccgtgctctggcgcgtcgcttccagaaaattgatattactgaaccgtcgatcgaagaaactgttcaaatcatcaatggcctgaaaccgaagtatgaagcgcaccacgacgtgcgttataccgcaaaagcggtgcgtgcggcggtagagctggcggtgaaatacattaacgatcgtcatctgccggataaagccattgatgttatcgacgaagcgggcgctcgcgcacgcctgatgccggtaagcaaacgcaagaaaaccgttaatgtggcggatattgagtccgtggtggcccgtattgcacgcattccagagaagagtgtttctcagagtgatcgtgataccctgaaaaacctcggcgatcgcttgaaaatgctggtcttcggtcaggataaagccattgaggcgctgactgaagccattaagatggcgcgtgcaggtttaggtcacgaacataaaccggttggttcgttcctgtttgccggccctaccggggtcgggaaaacagaggtgacggtacagctttcgaaagctttgggcattgagcttctgcgctttgatatgtccgagtatatggaacgccataccgtcagccgtcttattggtgcgcctccgggatacgttggttttgatcagggcggtttgctgactgatgcggtcatcaagcatccacatgcggtgctgctgctggacgaaatcgagaaagcgcacccggacgtgttcaatattctgttgcaggtgatggataacggtacgctgaccgataacaacggacgcaaagcagacttccgtaacgtggtgctggtgatgaccaccaacgccggggtacgggaaactgagcgcaaatccattggtcttatccaccaggataacagcaccgatgcgatggaagagatcaagaagatctttacaccggaattccgtaaccgtctcgacaacattatctggtttgatcatctgtcaaccgacgtgatccatcaggtggtggataaattcatcgtcgagttgcaggttcagctggatcagaaaggtgtttctctggaagtgagccaggaagcgcgtaactggctggccgagaaaggttacgaccgggcaatgggcgctcgtccgatggcgcgtgtcatccaggacaacctgaaaaaaccgctcgccaacgaactgctgtttggttcgctggtggacggcggtcaggtcaccgtcgcgctggataaagagaaaaatgagctgacttacggattccagagtgcacaaaagcacaaggcggaagcagcgcattaatctgattgttaggtaggttggtcaagtccgtaatctcgaaagaggttacggactttttgtttatggggtggaggaggttcagaccctttttttaatgatgatggtaagttgttgataattagtgctgcgggaaggtaaggataaaaaagggtgctgcaggagaatgggatggttttgctttattaacaacgggctaaacgtgtagtatttgagttcactgccgtacaggcagcttagaaattcacaggtaacatactccacccgcccaccatgttcactgccgtacagacagataaaatgcgaaaaaaaagctcgcactttcgtacgagctcttctttaaatatggcggtgagggggggattcgaacccccgatacgttgccgtatacacactttccaggcgtgctccttcagccactcggacacctcaccaaattgttttgctaccaaacctcatgggtggcaacggggcgctactatagggagttggagtaaaacggtcaagaagaattttaatgataattattgtttgctcatactgtaaacaagttgtgcagtatatctacatcgagacaagttacggacttatacttccaaagtacttcatacatatcacaaaataaaaaggccggttaaaccgaccttttactcgttctttctcttcgcccatcaggcggtaaaacaatcagcgactacggaagacaatgcggcctttgctcaggtcgtacggggtcagttcaacagtcactttgtcgcccgtcaggatgcggatgtagtttttgcgcattttaccggagatgtgtgcagtaaccacgtgaccgttttctaactctacgcggaacatggtattaggcaacgtttcaagaacggtaccttgcatttcaatattgtcttctttggccatctaatcctctggggtatcactaccgtaatttgaaccggcaagataatgccgaagttctgtaaataagtaaagatttgcgcgctaaatcgcaacaaacaggttcggcacattactccgaaaacacacggctaagccgcaccaaaagcgcaacgtataagggagcggtgagataaacgatgggcgttacctgacgcgaaaaattccttatcggcagcggggtaatgagcgtaaccaactctgcgaccgcaattataacactctggggagaaatgtgccgaaaacattcattcttgtggtgaaaacaagcatcgtggtacccagaaattattcggcaatcgtccgaggcgcatttgattgagataattaaggtaatcccggcggggaatttcgcaggcaccaagcgatgctgtgtgatcgttaaggacctggcagtcgataagcttaccgccatgaccgataaattcctcacagaataccagaagcgccgttttagacgcattttccatccggctgaacatggactcgccacaaaatagcgttccctgggccacgccgtacataccgccgacaagctcatcttcacgccagacttcaatggagtgggcatggccgagttcgtgaaggcgatggtaggcttcgaccacgccacgcgtgatccaggttccttcttcgcgatcgctggcacagccttcaatgacctgaccaaaagcgtaattcatcgtgacacgatagggcgagcgtttatgaaatcgcttcatactacggctgatatgcagtgattctggccatagcaccgcgcggggatcgggcgaccaccagaggatggggtcgcctggagaaaaccacggaaaaataccacgctggtaagccattaacaggcgcgcagggctaagatcgcccccaagtgccagcaggccgttaggctcacgtaatgcgccttccggggaagggaaggctattgaatggcgagaaagctgaaccaggcgcatgaccgcaaaactccacgcaagtcggatcgttcaataatagcttacaaaccctgcttgaactggtaataacgcccctgtctggcaagcagttctgcgtgagtaccttgctcaataatttgcccgttgtccatcactattatttgttggaaacgagagagtccgcgaagtcgatgggtgaccattaacaccgttttctcacgcatcatttctgcaagcaattcaaggatctggctttcggttgtggcatctaagccttcggtaggttcatccagcaacaccagtggcgcatcatgtaacagcgcacgggcgatagccagacggcgcagttcaccaccggagagctggcgtccgccttcacctaaccaactgttgagacctgcatcctcgagcagcttttccaggccaacgcgacgcaagatctccgacagagcctcatcactactgccaggcgaggcgagtaaaagattatcacgcagcgtggcgctaaacagatgcactcgctgaggaacaacgctgatggtctgtcgtagagccgcttcattcaggctggctatggggctatcgttaagcaaaatctcgccctgttgcgggtcccatgcgcgggtcagctgttgtaacagtgttgatttgccgcatccggttcgcccgagaatcgctatatgttccccggcgtttacctgaagagaaatccctttaagtgcctgttgagattgctccggataagtgaactgaacatcccgtaacgtcagcgaaacgcgatcggcaacacgagtttgggtatcaggaaaggtgacctccggtttttgatccgttaagtcagagatacgtacggcagaggcaatgacttgccccagatgctgaaatgcacccgttactggtgccagtgcttcaaacgcggctaacgcgcagaagacaaacagggcaattaacgcgccgggttgagcattgccgccaacgccgccagacgccatccacagcatcaggatcaccgctaacgcgccaatgagcagcattatcgcttgcgacaatgcggtcagttcagattgacggcgttgcgcttccagccattgaatttctgtattctctagttgcgtgcgataacgatcgctggcaccaaaaatggtcagctcagcttgcccttgcagccaggccgtcagttgttggcgatactgtccgcgaagatgagtcagattttgcccggtgctttttcccgcacgataaaacagcggtggcatcaggaaaagcgtcagtaacataatgccgcccagcgtaaaggcgagggtgaaatcaaggaaacttaacccgattgtcaccaccataatcaccacaaaagcgcccaccagcggcgagataacgcgcaggtaaagatgatcgagcgtatcaacatccgccaccacgcgattgagcaattcgccctgacgatagcgcgccagtccggcaggggagaggggcagcaatttgctgaaggtgtaaatgcgcagatgctgcaacacgcggaaagtcgcgtcgtgacttaccagacgttcaaaatagcgcccggcagtacgggtgattgctgcgccacgcacgcccgcagcgggtagcatatagttgaagctgtacagtccggcaacccccgcaaccgctgaggccgagaggaaccagccggaaagtgtcaacagaccgatactggcgagcagcgtcacaattgccagcacaataccaagacttaacatccatttatgacgtttatacagtgccagatagggtagcaaagcgcgcatttaaatctcctcctgacgatgggccagtaatgtggcgaatgggccaccagccacacttaattccgcgtaacgtccttgctcaataatccggccatcctgcataacccaaatgacatcccagtcagcaagatcttctaactggtgggtgaccattaacgttgtctggcgcagagaggcggcattcagcgcctccattacgcgctgttcactgtgagcatcaaggctggcagcgggttcatccaacagtaatagcgaacagggatttagtaacgcacgggccaccgccacgcgctgcgcctgccccacggaaaggcgggcagcctggtcgccaacaggcgtatcaacgccttgtgggaggagcggtagaaactcgctgacccaggcgttatccagcgctgcttgtaattcttgttcgctggcatcaggtcgcgccagtagtacgttatcccgcaatgttgctgccggtaattgtgggttttgcccaacccaggagagatgtttacgccatgattctggtgataaatcgcgtaattctatcccgttgattcgtagcgatccctgatatgagagaaaaccagaaagcgcgttcagcagtgagcttttacctgaaccgctgcgaccaaccaacaccgcacgttggcctgctggcaaagtaaagttcagcggtccggccagcgttttaccttccggcgacgtgataaacagctcctcggcctcaatggtcaccggatcggtcgatgctaattccgcctcaccacgttgcggatgggcgagcggggtttccataaacgttttcagactgtcagctgcgccaacagcctgggctttagcatgataaaacgtaccgagatcgcgtaatggctggaaaaactctggcgcaaggatcagggccagaaaacccgcagccagcgtcacaccggtatcgtagtgaccaaaatccagctcgccgagataggaaaaaccaaagtagaccgccaccagagcaattgacagcgaggtaaaaaattcgagaatgccggaggataaaaacgccagccgtagcacttccattgtccgttggcggaaatcttccgaagcagaacgaatactttcaatttcagcttcaccacgaccaaaaatacgcaatgtttccatgccgcgcaggcgatcgaggaaatgcccacttaagcgagcaagagcgagaaagttacgtcggttagcatcggcagcccccattccaaccagcgccataaacaacggaattaacggtgcagtgcccagcagaatgagcgccgcagcccagttagaggggaagattgccaccacaatcagcaacggcaccgacactgccagcgccatttgcggcagatagcgtgcatagtaatcatgcatatcgtcaatttgctcgagtaccagcgtcgcccagctccccgcaggtttaccctgaatccacgctggccctgcttgttgcagacggtcgagaacctgacggcggatggcaaagcggatatgctgcccggcgtgataacccacccgttcgcgtaaccagaccacccatgcgcgcagtacaaaggtcagaaccagtaacgtaaagggaagcagcagggcttcacggggaatattctccataatcatatgttgcagaattcgcgccatgaaccaggcctgggcaatgatcaatatgccgctcacaaagcccagcagacgagaaatattcagccaacgttgggagatgacgctttgctgttttaaccagcgggttaactctttttgacgagatttattcattgcacgcttagcaggtgagttatcagaattatttgcagagcaatgttacaacggggaaaaaataaaggcgacccatagtcgcatggtgtcgccttctttacttttgttactgatttgtaaaattattttgcgtcagctaaaccatcgaggtagcgttccgcatcaagtgctgccatgcagcctgtaccggccgaagtaatggcctggcgataaatgtgatccatcacgtcgcctgcggcaaagacgccaggaatgctggtctgggtggcattaccatgaatacccgactgtactttgatgtagccgttttccagttccagctgcccttcgaaaatcgcagtattcgggctgtgaccgatagcaacaaacagaccggcaacgtcgagtgactcgatgttatcgctgttttgcgtatcgcgcagacgaacgccagtgacacccatttgatcgccggtcacttcttccagcgtacggttggtgtgcagaatgatgttgccgttctccactttatccatcaggcgcttaatgaggattttttccgcgcggaaaccgtcacggcggtgaatcagatgcacttccgaagcgatgttagacagatacagcgcctcttcaaccgcggtattgccgccgccgatgaccgcaactttctggttgcgatagaagaaaccgtcgcaggttgcacaagcagaaaccccacggcctttaaaggcttcttcagagggcaggccgagatagcgtgcagaagctccggtggcaataatcagcgcgtcgcaagtgtattcgccgttatcgccattcagacggaacggacggttttgcagatccaccttgttgatatgatcaaaaatgatctcagtttcaaacttggtggcatgttcgtgcatgcgctccattaataacggaccggtcagatcgtttggatcgccaggccagttttccacttccgtggtggtggtcagttggccgcctttttccatgccggtaatcagcacaggttgcaggttggcgcgcgccgcgtagacagcagcggtgtatcccgccgggcctgaacccaggataagcagtttactgtgtttggtcgtgcccatgagatccccatagttgttggcagacaatgggcaggattgtagggaatttacagacgtaaaaaaagagtatgacgattttgttaacaatttgtgcaatcggcagcatcgataagcaggtcaaattctcccgtcattatcacctctgctacttaaatttcccgctttataagccgattaaatgatgaataaacgcccctgttaatgaatatctggcatgttgtactaaaaatcgatgttttgctttgacaatcccctggtgttttgcgaaaacattcgaggaagaaaaaaaacagtattcttatatgcgcataaccatgcatgtaaataccatgtttaccgtgctagtgaaatctacgtatggcgtggacagacgccattcgtgatgtcgatagctgccacaaggcaacggtcttctcaccgtagacccaggcattgcgcgccgtgaatcttcatgatttcggtctatcgtgacgggtagcgactctgaacagtgatgtttcagggtcagacaggagtagggaaggaatacagagagacaataataatggtagatagcaagaagcgccctggcaaagatctcgaccgtatcgatcgtaacattcttaatgagttgcaaaaggatgggcgtatttctaacgtcgagctttctaaacgtgtgggactttccccaacgccgtgccttgagcgtgtgcgtcggctggaaagacaagggtttattcagggctatacggcgctgcttaacccccattatctggatgcatcacttctggtattcgttgagattactctgaatcgtggcgcaccggatgtgtttgaacaattcaataccgctgtacaaaaacttgaagaaattcaggagtgtcatttagtatccggtgatttcgactacctgttgaaaacacgcgtgccggatatgtcagcctaccgtaagttgctgggggaaaccctgctgcgtctgcctggcgtcaatgacacacggacatacgttgttatggaagaagtcaagcagagtaatcgtctggttattaagacgcgctaacacggaacaggtgcaaaatcggcgtattttgattacactcctgttaatccatacagcaacagtactggggtaacctggtactgttgtccgttttagcatcgggcaggaaaagcctgtaacctggagagcctttcttgagccaggaatacattgaagacaaagaagtcacattgacaaagttaagtagcggccgccgccttctggaggcgttgctgatccttattgtcctgtttgccgtctggttgatggctgccttactaagctttaacccttcggaccccagctggtcgcaaacggcctggcatgaacctatccataatttaggtgggatgcccggtgcgtggttggcagatacgctgttctttatttttggcgtgatggcttacaccattcccgtcattattgtcggcggttgttggtttgcctggcgtcatcagtccagcgacgaatacattgattattttgccgtttcgctacgcatcattggcgttttggcgctcatccttacctcctgtggtctggcggcaatcaacgctgacgatatctggtattttgcctccggtggcgtcattggcagcttactaagcactacgctacaaccactgctacacagtagcgggggaactattgcgctgctctgcgtttgggcagcgggcctgacgttgttcaccggttggtcatgggtgaccattgctgaaaaactcggcggctggattttaaacattctcaccttcgccagtaatcgtacccgtcgcgatgatacctgggtcgatgaagatgagtatgaagacgacgaagagtatgaagatgaaaatcacggcaaacagcatgaatcacgccgtgcccgtattcttcgcggcgcgctagcgcgtcgtaaacggttggcggaaaaattcattaatccgatggggcggcaaacagacgctgcgttgttctccggtaagcggatggatgatgacgaagagattacctacactgcacgcggtgtggctgccgacccggacgacgtcctattttcgggcaatcgtgcaacgcagccagaatatgacgaatacgatccattattaaacggtgcgccaattaccgaacctgtcgctgtagcagctgctgctaccacggcgacacaaagctgggctgcgccggttgaacctgtgactcagacgccgcctgttgcctctgttgatgttccacctgcgcaacctacagtagcctggcagcctgtaccgggtccacaaacgggagagccggttattgctcctgcaccggaaggttacccacagcagtcacaatatgcgcagcctgcagtgcaatataatgagccgctgcaacaaccagtacagccgcagcagccgtattatgcacctgcagctgaacaacctgcgcaacagccgtattatgcccctgcgccagaacaaccggtggcaggtaacgcctggcaagccgaagagcagcaatccacttttgctccacagtctacataccagactgagcaaacttatcagcagccagccgctcaggagccgttgtaccaacagccgcaacccgttgaacagcagcctgttgtggagcctgaacccgttgtagaagagacaaaacccgcgcgtccgccgctttactactttgaagaagttgaagagaagcgagcccgtgaacgtgaacaacttgcggcctggtatcaaccgattccagaaccggttaaagaaccagaaccgatcaaatcttcgctgaaagcaccttctgttgcagcagtacctccagtagaagccgctgccgctgtttccccgctggcatctggcgtgaaaaaagcgacactggcgacgggggctgccgcaaccgttgccgcgccagtcttcagtctggcaaatagcggtggaccgcgtcctcaggtcaaagaggggattggtccgcagttgccacgaccgaaacgtatccgcgtgccaactcgtcgtgaactggcgtcttacggtattaagctgccctcacagcgtgcggcggaagaaaaagcccgtgaagcccagcgcaatcagtacgattctggcgatcagtacaacgatgatgaaatcgatgcgatgcagcaggatgaactggcacgtcagttcgcccagacacagcagcaacgctatggcgaacagtatcaacatgatgtgcccgtaaacgcagaagatgcagatgctgcggcagaggctgaactggctcgtcagtttgcgcaaactcaacaacaacgttattccggcgaacaaccggctggggcgaatccgttctcgctggatgattttgaattttcgccaatgaaagcgttgctggatgatggtccacacgaaccgttgtttacgccaattgttgaacctgtacagcagccgcaacaaccggttgcaccgcagcagcaatatcagcagccgcaacaaccagttccgccgcagccgcagtatcagcagccacaacagccggttgcgccgcagccacaatatcagcagccgcaacaaccggttgcgccacagcagcaatatcagcagccgcaacaaccggttgcgccgcagcagcagtatcagcagccacaacagccagttgcgccacaaccgcaggataccctgcttcatccgctgttgatgcgtaatggcgacagccgtccgttgcataaaccgacgacgccgctgccttctctggatttgctgacaccgccgccgagcgaagtggagccggtagatacctttgcgcttgaacaaatggctcgcctggtggaagcgcgtctggctgatttccgtattaaagccgatgtcgtcaattactctccggggccggttatcactcgctttgaattgaacctggcaccgggcgtaaaagcggcgcgcatttctaacttgtcacgggaccttgcccgttcactttcgacggtggcggtgcgtgtcgttgaagttattcctggcaaaccctatgtaggtctggagttaccgaataaaaaacgacaaaccgtttatctgcgcgaagttttggataacgccaaattccgcgataatccgtcgccattaaccgtggtgctgggtaaagatatcgccggtgagccggtggttgccgatctggcgaaaatgccgcacttgttggttgcggggactaccggttccggtaaatctgtcggtgtgaacgcgatgatcctgagcatgctttataaagcacagccagaagatgtgcgtttcatcatgatcgacccgaaaatgctggagctttcggtttatgaaggcattccgcatctgttaacggaagtcgttactgatatgaaagatgccgccaacgcgctgcgctggtgtgttaacgagatggagcgtcggtataaactgatgtctgcgctgggtgtgcgtaatctggcgggttataacgaaaaaattgctgaagccgatcgcatgatgcgtccgattccagacccgtactggaagccgggtgacagtatggatgcccagcatccggtgctgaaaaaagaaccatacattgtggtgttggttgacgaatttgccgacctgatgatgacggtaggtaaaaaagtggaagagctgatagcacgtctggcgcaaaaagcccgtgccgcgggtatccacctcgtactggcaactcagcgtccatcggttgatgttattactggtctgattaaagcgaatattccgacccgtatcgcctttaccgtatccagtaagattgactcacgtaccattcttgatcaggctggcgcggaatcactgctgggtatgggggatatgctctactctgggccgaactccacgttgccggtacgtgtccatggtgcttttgttcgcgatcaggaagttcatgccgtggtgcaggactggaaagcgcgtggtcgcccacagtatgttgatggcatcacctccgacagcgaaagcgaaggtggtgcgggtggtttcgatggcgctgaagaactggatccgttgttcgatcaggcggtgcagtttgtcactgaaaaacgcaaagcgtcaatttctggcgtacagcgtcagttccgcattggttataaccgtgcagcgcgtattatcgaacagatggaagcgcaggggattgtcagcgaacaggggcacaacggtaatcgtgaagtgctggccccaccgccgtttgactaactaatgcatcgtatgccggataaggcgcggtagcgtcgcatccggcactctatcaactgaaaattcagtattttcttctttcctcaagctgattattagcctggaatagagagtagagggaactcccgatcgggagtgacgtaatttgaggaataatgatgaaaaaaattgccatcacctgtgcattactctcaagcttagtagcaagcagcgtttgggctgatgccgcaagcgatctgaaaagccgcctggataaagtcagcagcttccacgccagcttcacacaaaaagtgactgacggtagcggcgcggcggtgcaggaaggtcagggcgatctgtgggtgaaacgtccaaacttattcaactggcatatgacacaacctgatgaaagcattctggtttctgacggtaaaacactgtggttctataacccgttcgttgagcaagctacggcaacctggctgaaagatgccaccggtaatacgccgtttatgctgattgcccgcaaccagtccagcgactggcagcagtacaatatcaaacagaatggcgatgactttgtcctgacgccgaaagccagcaatggcaatctgaagcagttcaccattaacgtgggacgtgatggcacaatccatcagtttagcgcggtggagcaggacgatcagcgcagcagttatcaactgaaatcccagcaaaatggggctgtggatgcagcgaaatttaccttcaccccgccgcaaggcgtcacggtagatgatcaacgtaagtagaggcacctgagtgagcaatctgtcgctcgatttttcggataatacttttcaacctctggccgcgcgtatgcggccagaaaatttagcacagtatatcggccagcaacatttgctggctgcggggaagccgttgccgcgcgctatcgaagccgggcatttacattctatgatcctctgggggccgccgggtaccggcaaaacaactctcgctgaagtgattgcccgctatgcgaacgctgatgtggaacgtatttctgccgtcacctctggcgtgaaagagattcgcgaggcgatcgagcgcgcccggcaaaaccgcaatgcaggtcgccgcactattctttttgttgacgaagttcaccgtttcaacaaaagccagcaggatgcatttctgccacatattgaagacggcaccatcacttttattggcgcaaccactgaaaacccgtcgtttgagcttaattcggcactgctttcccgtgcccgtgtctatctgttgaaatccctgagtacagaggatattgagcaagtactaactcaggcgatggaagacaaaacccgtggctatggtggtcaggatattgttctgccagatgaaacacgacgcgccattgctgaactggtgaatggcgacgcgcgccgggcgttaaatacgctggaaatgatggcggatatggccgaagtcgatgatagcggtaagcgggtcctgaagcctgaattactgaccgaaatcgccggtgaacgtagcgcccgctttgataacaaaggcgatcgcttttacgatctgatttccgcactgcataagtcggtacgtggtagcgcacccgatgcggcgctgtactggtatgcgcgaattattaccgctggtggcgatccgttatatgtcgcgcgtcgctgtctggcgattgcgtctgaagacgtcggtaatgccgatccacgggcgatgcaggtggcaattgcggcctgggattgctttactcgcgttggcccggcggaaggtgaacgcgccattgctcaggcgattgtttacctggcctgcgcgccaaaaagcaacgctgtctacactgcgtttaaagccgcgctggccgatgctcgcgaacgcccggattatgacgtgccggttcatttgcgtaatgcgccgacgaaattaatgaaggaaatgggctacgggcaggaatatcgttacgctcatgatgaagcaaacgcttatgctgccggtgaggtttacttcccgccggaaatagcacaaacacgctattatttcccgacaaacaggggccttgaaggcaagattggcgaaaagctcgcctggctggctgaacaggatcaaaatagccccataaaacgctaccgttaatgttatcgttgcggtaatgttgttactgtatccctgtggtcgcaggctgtggccacatctcccatttaattcgataagcacaggataagcatgctcgatcccaatctgctgcgtaatgagccagacgcagtcgctgaaaaactggcacgccggggctttaagctggatgtagataagctgggcgctcttgaagagcgtcgtaaagtattgcaggtcaaaacggaaaacctgcaagcggagcgtaactcccgatcgaaatccattggccaggcgaaagcgcgcggggaagatatcgagcctttacgtctggaagtgaacaaactgggcgaagagctggatgcagcaaaagccgagctggatgctttacaggctgaaattcgcgatatcgcgctgaccatccctaacctgcctgcagatgaagtgccggtaggtaaagacgaaaatgacaacgttgaagtcagccgctggggtaccccgcgtgagtttgactttgaagttcgtgaccacgtgacgctgggtgaaatgcactctggcctcgactttgcagctgcagttaagctgactggttcccgctttgtggtaatgaaagggcagattgctcgcatgcaccgcgcactgtcgcagtttatgctggatctgcataccgaacagcatggctacagtgagaactatgttccgtacctggttaaccaggacacgctgtacggtacgggtcaactgccgaaatttgctggcgatctgttccatactcgtccgctggaagaagaagcagacaccagtaactatgcgctgatcccaacggcagaagttccgctgactaacctggtgcgcggtgaaatcatcgatgaagatgatctgccaattaagatgaccgcccacaccccatgcttccgttctgaagccggttcatatggtcgtgacacccgtggtctgatccgtatgcaccagttcgacaaagttgaaatggtgcagatcgtgcgcccagaagactcaatggcggcgctggaagagatgactggtcatgcagaaaaagtcctgcagttgctgggcctgccgtaccgtaaaatcatcctttgcactggcgacatgggctttggcgcttgcaaaacttacgacctggaagtatggatcccggcacagaacacctaccgtgagatctcttcctgctccaacgtttgggatttccaggcacgtcgtatgcaggcacgttgccgcagcaagtcggacaagaaaacccgtctggttcataccctgaacggttctggtctggctgttggtcgtacgctggttgcagtaatggaaaactatcagcaggctgatggtcgtattgaagtaccagaagttctgcgtccgtatatgaacggactggaatatattggctaatacccaatttttctgaatctaaaaagcgcctgcgggcgctttttttgtctccctttgataccgaacaataattactcctcacttacacgtaatactactttcgagtgaaaatctacctatctctttgattttcaaattattcgatgtatacaagcctatatagcgaactgctatagaaataattacacaatacggtttgttactggaatcaatcgtgagcaagcttgagtgagccattatgaaaacgaaaatccctgatgcggtattggctgctgaggtgagtcgccgtggtttggtaaaaacgacagcgatcggcggcctggcaatggccagcagcgcattaacattaccttttagtcggattgcgcacgctgtcgatagcgccattccaacaaaatcagacgaaaaggttatctggagcgcctgtacagttaactgtggtagtcgctgcccgctacgtatgcacgtcgtggacggtgaaatcaaatatgtcgaaacggacaataccggcgatgacaattacgacggcctgcaccaggttcgcgcctgcctgcgtgggcgttccatgcgtcgccgtgtctacaatccggaccgcctgaaatatccgatgaaacgagtcggggcgcgcggtgaaggcaaattcgagcgcattagctgggaagaagcctacgacatcatcgcgaccaatatgcagcgcctgatcaaagagtacggcaacgagtctatctatctgaactatggcaccggtacgctgggcggcaccatgacccgctcctggccgccgggaaataccctggtcgcgcggctgatgaactgctgcggcggctatctgaaccattacggcgactactcctccgcgcaaattgcggaaggtttgaactatacctacggcggctgggcagatggcaacagcccgtcggatatcgaaaacagtaagctggtagtgctgtttggtaataaccctggcgaaacgcgaatgagtggcggtggggtgacttactatcttgaacaggcacgccagaaatctaatgcccgcatgatcatcatcgatccgcgctataccgacaccggtgccgggcgcgaagatgagtggatccctattcgtccgggaacagatgccgcactggttaacggtctggcgtacgtcatgatcactgaaaacctggtggatcaggcattcctcgataaatattgcgttggctacgatgagaaaaccctgccagccagtgcgccgaaaaatggccactataaagcttatattctgggtgaagggccagatggcgtggctaaaacgccggaatgggcctcgcaaatcactggtgttccggcagacaaaatcatcaaattggctcgtgaaatcggtagtaccaaaccggcgtttatcagccagggatggggcccgcagcgtcacgctaacggtgaaatcgcaacccgtgctatctcgatgctggcgattctgaccggtaacgttggtattaacggaggcaacagcggcgcgcgtgaaggttcatacagcttaccgtttgtccgtatgccgaccttggaaaacccgatccagaccagcatttcgatgtttatgtggaccgatgccattgaacgtggcccggaaatgacggcgctgcgtgatggtgtacgcgggaaagataagctggatgtgccgatcaaaatgatctggaactatgccggtaactgcctgattaaccagcattctgaaatcaaccgtacccatgaaatccttcaggatgataagaagtgcgagctgattgtggttatcgactgccacatgacctcatcggcgaaatatgctgacatcctgctgcctgactgcaccgcttccgaacagatggactttgcgctggatgcatcctgcgggaatatgtcttacgtgattttcaacgatcaggtgattaaaccgcgctttgaatgtaagaccatctatgaaatgaccagcgaactggcaaaacgtcttggcgttgagcaacagtttactgaaggccgtacccaggaagagtggatgcggcatctgtatgcccagtcgcgggaagcgattcctgaactgccaacgtttgaagagttccgcaagcaggggatctttaaaaagcgcgacccacaagggcatcacgttgcttataaagccttccgtgaagatccgcaggcaaacccactgactacgccatcgggcaaaattgagatttattcgcaggcgctggctgacattgccgctacctgggaattgcctgaaggcgatgtgatcgatccactgccgatctacacgccgggctttgaaagttatcaggatccgctgaacaaacagtatccgctgcagcttacaggtttccactataaatctcgcgttcactcaacttacggcaacgttgatgtgctgaaagcggcttgccgtcaggaaatgtggatcaacccgcttgatgcccaaaaacgcggtatccacaacggcgataaagtcaggatctttaacgatcgtggtgaggttcatattgaggcgaaagtgacgccacgaatgatgccgggtgtggtcgcactgggtgaaggtgcctggtatgacccggatgcaaaacgtgtcgataagggtggttgtattaacgtactgaccactcaacgtccgtctcctctcgctaaggggaatccgtcacatacaaaccttgttcaggttgaaaaggtgtaaggagtaaccgatgacaacccagtatggattttttattgattccagccgttgcaccggttgcaaaacctgcgagctggcctgtaaagactacaaagatttgacgccagaagtcagcttccgccgcatttatgaatatgctggcggcgactggcaggaagataacggtgtctggcaccagaacgtgtttgcctactatctgtcgatttcatgtaaccactgcgaagatccggcttgtactaaagtctgcccgagcggtgcgatgcataaacgtgaagatggttttgttgtggtcgatgaagatgtgtgcattggctgccgctactgccatatggcttgcccgtatggcgcaccgcaatataacgaaacgaaaggccatatgaccaaatgcgatggttgttatgaccgtgttgcggagggtaaaaagccgatctgtgttgaatcttgtccgctgcgggcgctggatttcggccctatcgacgagctgcgtaaaaaacatggcgatctggcggccgttgcgccgttgccgcgagctcactttaccaaaccgaatattgtgatcaaacccaatgccaatagccgcccgaccggggataccactggctatctggcaaacccgaaggaggtgtgagatgggaagtggatggcatgaatggccgctgatgatcttcacggtcttcgggcaatgtgtagcaggtggttttatcgttctggctttggcgctgctcaaaggcgacctgcgagcagaagcccagcagcgtgttatcgcctgcatgtttggtttatgggtgctgatgggcattggctttatcgcctctatgctccatcttggttcaccaatgcgcgcttttaactcgctcaaccgggtaggggcttcagcactcagtaacgaaatcgccagcggttcgatcttttttgccgtaggcggcatcggctggttgctggcaatgctgaaaaagctgtcaccggcattgcgtacgctgtggctgatagtgacgatggttcttggcgtcatctttgtctggatgatggtgcgtgtgtataacagcattgataccgttccgacctggtacagcatctggacgccgatgggcttcttcctgacgatgtttatgggcggcccgttactgggttacctgttgttgagtctggctggcgtcgatggctgggcgatgcgtctgctgccagcaatttctgtactggcactggtagtgagtggcgtggtgtcagtgatgcagggcgcagagctggcgactattcatagttctgtgcagcaggccgcagcgctggtgccggactatggtgcgctgatgtcctggcggatcgtgcttttggccgttgccctgtgcttgtggattgcaccacagctaaaaggttatcagcctgcggttccgctactttctgtatcattcattctgcttctggcaggggaattaatcggtcgcggcgtattctatggtttgcatatgaccgtggggatggccgtcgcaagctaatcataacaaccggggtttcggccccggttctcttttatttctgcttcgttaacgtgtcataactggtcatcaaattacgataatcaggaatgtggttagagaacaacgtcgccagtccttcaatatcattacgccagtcgcgatgcagctcgcacgccacgccgaaccatgtcatcaattgcgcaccagcttgcgacaagcgatcccatgccgaatgccgggtaatttcattaaaggtccctgacgcgtcagtcacgacaaagacgtcaaacccttcttcaatggctgaaagcgccgggaatgccacgcaaacttcggttaccacaccggcaataattaactgttttttacctgtcgctttgacagcttttacaaaatcttcgttatcccaggcgttaatatttcccgggcgagcaatgtaaggtgtatcggggaattgtgctttcagttctggaactaatgggccgttaggaccggtttcaaaactggtggtaagaatagttggtaagttgaaatacttagccaggtcacccagcgccagcacgttatttttaaacttatcgggttcgatatcccgtacaagggaaagtaaaccagcctggtgatcaacaagcaaaacggcagcatcatttttatcaagacgaacatacggtttggtcatcctcttctcctttcgagagtcagtggtacgtctgaaatcgatcagacgcgatgcattgctctgaaagcatagacgggaaatatgagtttgctgtgaccatgaaatttttcgactgaacgaagcgtatgaaatttgtgttagttcaataaaaacaatcagatgagactaatcatctcttcagcattagcgttatgaatgagtaatataaatcgataataccgccgctgggatatcgcgtattttcacccattgacaatgtttttggcggtggcatgatgcgcatgaaatttgaacttcctcacggttttaattcatgtccacgtatacccagcctgtcatgcttttgctgtctggcctgcttttgttgactctggcgattgcggtgttaaatacactcgtgccgctttggctcgcccaggaacacatgtccacatggcaggtaggcgttgtcagctcatcctattttaccggcaaccttgtcggtacattgctgacagggtatgtcattaagcgcattggctttaaccgcagctattatctggcctccttcatttttgccgctggctgtgccggccttggcctgatgattggattctggagctggttggcttggcgttttgtcgcgggcgtcggctgtgccatgatttgggtggttgttgagagcgcgctgatgtgcagtgggacgtcacgtaaccgtgggcgtttgcttgctgcgtatatgatggtttattacgtgggaacgtttttaggccagttactggtcagcaaagtttcaaccgagctgatgtccgtattgccgtgggttacaggtttgacgttggcagggatcttaccgctgttgtttacgcgtgtgctgaatcagcaggctgaaaaccatgattcgacgtcaattacgtcaatgctaaaactccgtcaggcgcggcttggcgtgaatggctgcattatctcaggaatcgttctgggatctctatatggcctgatgccgctgtacctcaatcacaaaggggtgagcaatgccagcattggtttctggatggcggtactggtcagtgcgggtatccttggacaatggccgattggacgtctggcggataagtttggtcgactgctggtgttgcgtgttcaggtctttgtcgtcattctcggcagtatcgcgatgcttagccaggcggcgatggccccagcgttattcatcctcggtgccgctggctttacgctatatccggtggcgatggcatgggcttgcgagaaagttgaacatcatcaactggtggcgatgaaccaggccttactgttgagctatactgtgggaagtctgcttggcccgtcatttaccgctatgctaatgcagaatttctccgataatttattgtttatcatgatcgccagcgtatcgtttatctatttgctgatgctgctgcgcaacgccggtcatacgccgaaacccgttgctcacgtgtaaatgaattcaagcagagtgtgaacttactgtttcacactctgcttttttgtttcttctatctgacttgctttattccaaattttattcgtttaaaaataaaatgtgcagcaggttataattttgcatttcgctatttccgcacttcttatttgccgcgcataatccctcgttttaccgatgcccctttaattttggcgaaggatttgtctatggctgggaatgttcaggaaaaacagttgcgatggtacaacattgcgctgatgtcttttatcactgtctggggttttggcaacgttgttaataactatgccaaccaggggctggtggttgttttttcatgggtgtttatctttgcactctatttcacaccttatgcgctaattgttggtcagttaggctcgaccttcaaagatgggaagggcggggtcagtacctggattaaacacacgatgggacccggactggcttatctcgccgcgtggacctactgggtggtgcatattccctatctggcacaaaaaccccaggcaattctgattgcgctcggttgggcgatgaaaggcgacggttcgctaatcaaagaatattcagtcgtagcgttacaggggttaacgctggtgctgtttatcttctttatgtgggttgcttcacgcggtatgaaatcgctgaaaatcgtcggttctgtggcagggattgctatgtttgttatgtcactcctgtatgtggcgatggcggtaaccgcgcctgcaattactgaagtgcatattgcgaccacaaacattacctgggaaacgttcattcctcatatcgactttacctacattaccactatttcaatgctggttttcgcggttggcggagcagagaagatttctccttacgttaatcaaacgcgcaacccaggaaaagaatttccaaaagggatgttatgcctggcggtgatggttgcggtttgtgccattctgggctcgctggcgatggggatgatgtttgattcgcgtaatatcccggatgacttaatgaccaacggtcagtattacgcctttcagaagctgggcgagtattacaacatgggtaatactttaatggtgatttacgccattgcgaataccctgggacaagtagcggcgctggtattctcgattgatgccccgcttaaagtgctattaggtgatgctgacagcaaatatattccagccagtttatgtcgtaccaacgcttctggtacgcccgttaatggctattttctgaccctggtactggtggcgattctgattatgctgccgactctcggcattggtgatatgaacaatctctataaatggctgttgaaccttaattcggtagtgatgccgctgcgttatttatgggtatttgttgcatttattgcagtcgttcgcttggcgcagaaatataaaccagaatatgtctttattcgtaataagcctctggcaatgaccgtcgggatttggtgttttgcctttaccgcctttgcctgtttgacggggatcttcccgaaaatggaagccttcactgcagagtggaccttccagttggcgctgaatgttgcaacgccgtttgtgctggtaggattaggactgatattcccgctgctggcgcgtaaagcgaatagtaaataattattgtggtcggtgacgctgactctggcagatctgacccgtttttacataatcgagaaatgcgcgcaagccgcaggacatatactggcggtttggataatagatctggaagcctggacgctctgtgctccagtcttccagtacacattctaaacgaccagtatcaaggtactccttgatctgttcatagagcagatacccgataccagcacccatcaaaacggcctccagttcagcatcaacatcatccagaatgatatttcctgcgacagcaatttccagctcctttgcaaattgccagtggaaaggtttgccgctgggataacgaaaaacaacacattgatgattaagcagatcatgaggatggcggggtttgccatatcttgcaaagtactctggcgttgctgctacacataatttcactggcgggccgatcgccacgctgatcatatctttttcgacgatgcaactaagtcgaacgccagcgtcaaagccctgttggacgatatcgacaagagagtcgtcagttgtgagctcgactttaatatcaggatattcacgtgtgaaaccaaccagtaaagacattaaaaatatacgtgcagctacccgggcggcattgattttgagcgttcctgtcggtgtcagacgaaaatcattcatctcatctaacatgatctgaatttcgtcgaaagctgggcgcaatcgttcatagagattagaacccgcttccgttaacgatacgcttcgggttgtccgattgaataagcgaattttaagacgttgttccagtgttttaatactatggctaatggcggacgaggataagcctaactcatcgcccgctgcacgaaagctttgattacgggccacggcaaagaaagtggcaaagtcagacatattcatccgcattagtgaaaatccttcattaactcatcctgaatcatcacgtttacaggattatgccgcctgcgtaaagtgcgctccagaacttaacgtggaggtaaaattatgcagtctgaacgtatttatttggtatgggcccatcctcgtcatgattcattgaccgcacatattgctgatgcgatccatcagcgggcaatggagcggaaaatacaggtgacggaactcgatttatatcggcgtaatttcaacccagtgatgacgccggaagatgaaccagactggaagaatatggataaacgttattctccagaggttcatcagctttattcagagctgcttgaacatgacacgttagtggtggtttttcctctctggtggtacagcttcccggcaatgctaaaaggatatattgacagagtatggaataatgggctggcttatggagatgggcacaaattaccattcaataaagttcgttgggtggcgctggttggaggagacaaagaatcatttgtccagatgggctgggaaaaaaatataagcgattatttaaaaaatatgtgcagttatcttggtattgaagatgccgatgtcactttcttgtgtaatacagtggtattcgatggggaagaacttcacgcgagctattatcagtcgttattatctcaggtacgggatatggtagatgcactataagatgtgttaaaaacgctgtagcagaatgaagcgcggaataaaaaagcggcaactcaataaagttgccgctttacggggaaattagaacattaccttatgaccgtactgctcaagaatgcctttcacgcgttccatggtctctttcttcggtggtttaacaccgtcgagtttgtactcttcacccattgccacccatttgtgtttgcccagctcgtggtaggggagaagctcgattttctcaacgttgcccatatcacgggtaaattcaccgaggcgatgcgctgaatcgtcatcgtcagaccagcctgggacaacaacgtagcggatccacaccttcacatttttgttcgccagatatttagcgaactccagcgtgcggtggttggaaactccaaccagattttggtggatctcgtcgttcatctgtttgagatcgagcattaccaggtcggttacttccagcagttcatcaatcaccggatcgtaacgacgaacaaaaccgttggtgtccagacaggtatgaatgccttcttttttgcaggcgcggaaccagtcacgaacaaactcagcttgcaggattgcttcaccgccggatgcggtaacgccgccgccggaagcgttcataaagtggcgataggtcaccacttccttcatcaaatcttcaacggtaacttctttaccgccatgcgtgtcccaggtgtcgcggttatgacaatacaggcagcgcatcaggcagccctggaaaaaggtgataaagcgaatacctgggccgtctacggttccacaggattcaaaggagtgaatgcgaccaataactgacattgcggtgtttctccagatgtggcccatctgaggccgtgttggtgcgcagctcgaaggctacgtcgagtctgttttggcagtcaccttaaagtatagatagctgacaaaaaaggctctcgcgctaaaaaaggccccactttcgtggagcctttattgtacgctttttactgtacgatttcagtcaaatctaattacatagattgagtgaaggtacgagtaataacgtcctgctgctgttctttagtcagcgagttgaaacgtactgcgtagccagatacacggatggtcagctgcggatatttttccgggttttccatcgcgtcgagcagcatttcacggttcatcacgttaacgttcaggtgctgaccaccttcgatggatgcttcgtggtggaagtaaccatccatcagaccagccaggttggtcttacgaacttcgtcgtctttacccagtgcgttcggaacgatagagaaggtgtaggagataccatctttagcgtaagcaaacggcagtttagcaacggaagtcagagaggctactgcacctttctggtcacgaccgtgcatcgggttagcacccggtccgaacggcgcgccagcacgacgaccgtctggggtgttacccgttttcttaccatacacaacgttagaagtgatggtcagaacagactgagtcgggatagcgtcacggtaggtgtgcagtttctgaattttcttcatgaaacgttctaccaggtcaacagccaggtcatctacacgcggatcattgttaccaaactgcgggtattcgccttcgatttcgaagtcgatagccagaccgtcttcgtcacgaatcggtttaactttcgcatatttgattgcagacagggagtcagcagcaacggacagaccagcgataccacacgccatggtgcggataacgtcacggtcgtgcagcgccatcagagaggcttcgtagctgtacttgtcgtgcatgtagtggatgatgttcagtgcagtgatgtactgtttagccagccagtccatgaagtgatccatgcgctccatcacttcatcatagttcaggacatcgcctttgatcggttcagacttcggaccaacctgcattttcagtttttcgtcaacgccgccgttgattgcgtacagcatggttttcgccaggtttgcacgcgcaccgaagaactgcatttgtttaccaacgatcatcgggcttacgcagcaagcaatagcgtagtcatcgttgttgaagtccggacgcatcaggtcatcgttctcatactgcagagaagaggtgtcgatggacactttagcggcgaatttcttgaagttcagcggcagtttttcagaccacagaatggtcatgttcggttccggagacggacccatggtgtacagggtgttcaggaaacggaagctgtttttggtaaccagggtacgaccgtcgaggcccataccaccgatagattcggttgcccagatcgggtcgccagagaacagttcatcgtattccggagtacgcaggaagcgaaccatacgcagtttcatgaccaggtggtcaaccatttcctgcgcttcttgttcggtgatcttgccagctttcaggtcacgttcgatgtacacatccaggaaggtggaggtacgaccgaaggacattgcagcaccgttctgagacttaacagcagccaggtagccgaagtaagtccactggatagcttcctgagcgttggtagccggaccagagatgtcgtagccgtatttcgcagccatttctttcatctgacccagagcgcggtgctgttcagcgatttcttcgcgcagacggatagtctgttccaggtttacgccgttttccagatcagcctgcagagaagtgaactgtgccagtttgtctttcatcaggtagtcgataccgtacagcgcaacgcgacggtagtcaccgatgatacggccacggccatatgcatctggcagaccggtcagaacaccagatttacggcaacgcaggatgtccggagtgtaaacgtcgaacacgccctggttgtgagttttacggtattcagtgaagatttttttgatcatcggatccagttcgcggttgtacgctttgcaggaaccttcgatcattttgataccaccgaacgggataagagcacgtttcagcggagcttcagtctgcagaccaacgattttctcaagctgcttgttgatgtagccagcgtcgtgagaggtgatggtggaagcaacagcggtgtcaaagtcaactggcgcgtgagtgcggttttccagtttaacgccttccattactttgtcccacagggtggtggtcgcttcagtagcgccagccaggaaggactcgtcaccctcgtacggagtgtagtttttctgaatgaagtcacggacgtttacttcattctgccagtcacctttggtaaaaccttcccaggctgtggctaacttttcattaagctcggacatgtaacacctaccttcttaagtggattttttatttactgcgtacttcgacaaccattaatggtggtcgttttcacgcaggtaaatgacccagtatgtcaacccaaccaacaaaccaccaccgataatgttgccgatcgtaaccggaatcaggttatcagtgatgaaattcatcacggtcaggtgagaaaaattttccggtgcagaaccgactgcggtccaaaattccggggatgcgaagtcgcggattacaatacccatcgggatcataaacatgtttgcgatactgtgctcaaaaccgctggcaacaaacatcgcgaccggcagcaccataatgaacgctttgtccatcaggctgcggccagaataactcatccatactgccagacataccatcaggtttgccaggataccaagacagacggcctcaataaaagtatggtgcactttgtggtcggcggtttgtaggacgtttagtccccattgaccatttgcggtcatatactcgccggaaagccacattaaaagtacaaacagcagtgcgccgaccaggttgccaaaatagacatttagccagtttttcgccaactgaccccaggtgatgcgcccactcgccttagcaacaacaatcaacacggtggaagtaaagagatcggctccgcagacaacacaaagaatcagccccagagagaagcaaatgccgccaaccagttttgccatgccgaagggcattgtgcctgtgccagtggttgctgtgatatagaagacgaatgcgattgagatgaaaacaccggcggtaatcgccagatagaaagtcttaagcggatgtttcgttgctttatagacacccgcctcttcggccactttggccattgcagcaggaagtaaaagatcaaaagggttgtcagctttcacactaactctctctttattaagtcggcgacgagatactaacaaagcattatagatgagaaattgatatagatcatatctcgcctggcttataggcccgtaactcgcatggtttttatgcaaatacggagtaaatatttgattatccaaataaaaataaattttaaaaattaacaaatgagttgaattttttccgcatcctccgctaaaacagttaattaaaagggagcatcaggcgaataaagtaacaatatcgatcgtatttattaaatacaaattaccgatatttaaccttataattacaattattttattaatgcaaatatatgtaaagcggggcattaaaaaaacgccccgtaatataactcagactaatcattaagcctacattgcgtaggctatttgattttattttgcccagaatgctgctttggcgcgctgcagcttttcgtaggccttcaacaacgactgatgtgcagcaaacgcgtgcagatcgctatctaccggttgcaggccgtaaaacgccgcttcgccgctcattgccgcactggcggcttctacggcatctgcgccgtacatgcgaacaaacgcattcagatattgcagcggctggcgatcttcttcctgtgccagtaataacaacgtttgcaggcagcgataatagttggcgcgttccggactaaatactgatgagttaaactccatcgtccattcggtccagaccagagcctgttccagatcgccaccagccagcgccagcatggcttttaattcaccgatacgcagggtgtaccaaccgttatccgacccggtcgccagacccaacagctcacgcacgcgggtaaagtcatcaaaaccttcttcatccagttgctcgatgaggttcaggtaatcttctttttcccactcgctgcctggtagcgaaagaatcgtttcacgtaaatggctgcccatactgttattcgcgagccacagatcttcagccggataaatatcggacatgccaggcacgataatacggcaagcataaacgcccagatgctcgtaatcggcaatataaacttctttatcttctttgttgaagatagccatcagtgtggcgaactcttcttccgtggtgccggagaaattccagtccacaaacggataatcggcatcctgcttgaacaggtcccaggagattaaaccgctggaatcgataaagtgcgtttcgaggttggtatgttcagcgacttcttcatcatcgaaggttggcggagtaaacacatccaaatctttcaggccacgaccttgcagcagctcggtcacggtacgttccagtgctacgccaaaatcaggatgcgcaccgaaagaggcaaagcaggtaccgttagcaggattgaacagtaccacgcaaatcaccggatactggccgccaagcgaaccgtcataagcgaagattgggaaaccctccgcttccagcgtttcgatggcttcaactactgctgggtaacgcgccagcacgtctgccgggatctctggcaggctgatgctttcagcaataatgcggtttttcacgtagcgttcgaaaacttcagacaatccctgaacgcgtgcttcgttgcgggtattacctgcggacataccgttggagacgtacaggttaccaatgatattcatcggaatataaacggtctgattgtcggactgacgcgtaaacggcaggccgcaaataccacgatcttcgttaccggattgtaggtcaatcagcatgctgccggtcagttcattctccggatcataaaacgcgcgcagacggtcatcgagcagcccttctggcacatcgtcattttcggtcagtgggaaccatttttcgttgggataatgcacgaacggaccgttggcgatggtttcgcccagccagaagtccgcaaaaaagtagttggttgagagacgctcgaaatattcaccgagtgcagaagccagcgccgctttcttggttgcgcctttaccgttggtaaaacacagtgcgcactctttgtcgcgaatatgtacagaccagacgttaggcacgggattcagccaggaggcctcttcaatctgaaagccgaggtctgaaagtttttgctggaagcgagcgatggaatcttccagagcggcatctttgccggggataaatgtttgcgtcatgaaaatcactttagtcgtacggaaagcgcgcaataatacgggttttatctcaaaggcgctatcaccgccgccatgccgatgaactgttgactatgcttttagcggataaaccacgttaagagcataaaaatgaaggcgttcgatctccaccgtatggcatttgataaagtgccttttgatttccttggcgaagttgcactacgtagtctttatacctttgtactggtctttttgttcctcaaaatgaccggaagacgcggtgtgcggcagatgtcgctgtttgaagttttaatcattctgacgctgggatcagcggcgggagatgtggcgttttatgatgatgtgccgatggtcccggtacttatcgtctttattactctggcgttgttataccgcctggtaatgtggttgatggcgcacagtgaaaaactggaagatcttctggaaggcaagccagttgtcattattgaagatggcgagctggcctggtcgaaactcaataactccaacatgacggaatttgagttctttatggagctacgattgcgtggcgtggagcagctggggcaggtacgtctggcgattctcgaaaccaacgggcaaatcagtgtctatttctttgaagatgacaaggtgaaaccgggtttacttattttacccagtgattgtacgcagcgttacaaagtggtgccggagtcggcggactatgcctgtattcgttgtagtgaaatcattcatatgaaagcgggggaaaaacaattatgtccgcgctgtgcaaatccagaatggacgaaggcaagtcgggcaaaacgggtgacctgacagtaaaaacatcggctttttgctaataatccgagagattcttttgtgtgatgcaagccacatttttgccctcaacggttttactcattgcgatgtgtgtcactgaatgataaaaccgatagccacaggaataatgtattacctgtggtcgcaatcgattgaccgcgggttaatagcaacgcaacgtggtgaggggaaatggctcaaatcttcaattttagttctggtccggcaatgctaccggcagaggtgcttaaacaggctcaacaggaactgcgcgactggaacggtcttggtacgtcggtgatggaagtgagtcaccgtggcaaagagttcattcaggttgcagaggaagccgagaaggattttcgcgatcttcttaatgtcccctccaactacaaggtattattctgccatggcggtggtcgcggtcagtttgctgcggtaccgctgaatattctcggtgataaaaccaccgcagattatgttgatgccggttactgggcggcaagtgccattaaagaagcgaaaaaatactgcacgcctaatgtctttgacgccaaagtgactgttgatggtctgcgcgcggttaagccaatgcgtgaatggcaactctctgataatgctgcttatatgcattattgcccgaatgaaaccatcgatggtatcgccatcgacgaaacgccagacttcggcgcagatgtggtggtcgccgctgacttctcttcaaccattctttcccgtccgattgacgtcagccgttatggtgtaatttacgctggcgcgcagaaaaatatcggcccggctggcctgacaatcgtcatcgttcgtgaagatttgctgggcaaagcgaatatcgcgtgtccgtcgattctggattattccatcctcaacgataacggctccatgtttaacacgccgccgacatttgcctggtatctatctggtctggtctttaaatggctgaaagcgaacggcggtgtagctgaaatggataaaatcaatcagcaaaaagcagaactgctatatggggtgattgataacagcgatttctaccgcaatgacgtggcgaaagctaaccgttcgcggatgaacgtgccgttccagttggcggacagtgcgcttgacaaattgttccttgaagagtcttttgctgctggccttcatgcactgaaaggtcaccgtgtggtcggcggaatgcgcgcttctatttataacgccatgccgctggaaggcgttaaagcgctgacagacttcatggttgagttcgaacgccgtcacggttaatgccgaaattttgcttaatccccacagccagcctgtggggtttttatttctgttgtagagagttgagttcatggaatccctgacgttacaacccatcgctcgtgtcgatggcactattaatctgcccggttccaagagcgtttctaaccgcgctttattgctggcggcattagcacacggcaaaacagtattaaccaatctgctggatagcgatgacgtgcgccatatgctgaatgcattaacagcgttaggggtaagctatacgctttcagccgatcgtacgcgttgcgaaattatcggtaacggcggtccattacacgcagaaggtgccctggagttgttcctcggtaacgccggaacggcaatgcgtccgctggcggcagctctttgtctgggtagcaatgatattgtgctgaccggtgagccgcgtatgaaagaacgcccgattggtcatctggtggatgcgctgcgcctgggcggggcgaagatcacttacctggaacaagaaaattatccgccgttgcgtttacagggcggctttactggcggcaacgttgacgttgatggctccgtttccagccaattcctcaccgcactgttaatgactgcgcctcttgcgccggaagatacggtgattcgtattaaaggcgatctggtttctaaaccttatatcgacatcacactcaatctgatgaagacgtttggtgttgaaattgaaaatcagcactatcaacaatttgtcgtaaaaggcgggcagtcttatcagtctccgggtacttatttggtcgaaggcgatgcatcttcggcttcttactttctggcagcagcagcaatcaaaggcggcactgtaaaagtgaccggtattggacgtaacagtatgcagggtgatattcgctttgctgatgtgctggaaaaaatgggcgcgaccatttgctggggcgatgattatatttcctgcacgcgtggtgaactgaacgctattgatatggatatgaaccatattcctgatgcggcgatgaccattgccacggcggcgttatttgcaaaaggcaccaccacgctgcgcaatatctataactggcgtgttaaagagaccgatcgcctgtttgcgatggcaacagaactgcgtaaagtcggcgcggaagtggaagaggggcacgattacattcgtatcactcctccggaaaaactgaactttgccgagatcgcgacatacaatgatcaccggatggcgatgtgtttctcgctggtggcgttgtcagatacaccagtgacgattcttgatcccaaatgcacggccaaaacatttccggattatttcgagcagctggcgcggattagccaggcagcctgaatgaacaacgggcaataaatagccaaatctttctttatcaaaacgtcggcacattgtcggcgttttttttcggaccttgtgagtcattttgattaatggtagcgtcgcttgtcaatgtaagttgttgatacataatatttatatatgattaatcaacggatgattcacatgaagaatactaaattactgctggcgattgcgacctctgcagcattactgacagggtgtcaaaatacccacggtattgataccaatatggctatcagctccggtttaaatgcctataaagcagcaacattaagcgatgccgatgcaaaagcgattgccaatcagggctgtgccgaaatggacagcggcaatcaagtcgcaagtaaatccagcaagtacggtaaacgtctggcaaaaatcgccaaagcattgggtaacaatattaatggcacgccggtcaactataaggtttatatgaccagcgacgtcaacgcatgggcgatggcgaacggctgtgttcgtgtctacagtggcctgatggacatgatgaatgacaacgaaattgaaggcgttctgggccatgaactgggccacgtcgcgttgggtcactcgctggctgaaatgaaagcttcttatgcgatcgttgccgcacgcgatgccatttcagctaccagcggtgtggcttcccagctttcccgctcacaattaggtgatatcgcagaaggcgctatcaatgctaaatactcccgtgataaagagtccgaagcagatgatttctcctttgatctgttgaagaaacgtggcatcagcacccaggggctggttggcagctttgaaacactggctagcctggatggcggtcgcacccagtccatgtttgactctcacccaccatcaacagagcgtgcgcaacacatccgtgatcgtatcgcctctggtaagtaaatcattgtcatctttcgggctggtcttctgccagcccgctataattgcgcaataaatccccatctgaatacagacaaaactggtttttgcacacaacgttaacgatttgtggcgtcggcgcgtataatgcgcgcggttatgttaacggtacgcctgttttaaggagataaagatgacggcaattgccccggttattaccattgatggcccaagcggtgcagggaaaggcaccttgtgtaaggctatggcggaagcgttgcaatggcatctgctggactcgggtgcaatttatcgcgtactggcattggcggcattacatcaccatgttgatgttgcgtcggaagatgcgctggtaccgctggcatcccatctggatgtacgttttgtgtcgaccaatggcaatctggaagtgatcctcgaaggggaagatgtcagcggcgaaattcgtactcaggaagtggcgaatgcagcttcacaagtcgcggcattcccacgcgttcgtgaagcattattgcgtcgccaacgcgcgtttcgcgaattaccaggtctgattgccgatggccgcgacatgggaacggtggtattccctgatgcaccagtgaaaattttccttgacgcctcctcggaagaacgtgcgcatcgccgcatgctacagttgcaggagaagggctttagtgttaactttgagcgccttttggccgagatcaaagaacgcgacgaccgcgatcgtaaccgagcggtagcgccactggttccggcagccgatgctttagtgttggattccaccaccttaagcattgagcaagtgattgaaaaagcgctacaatacgcgcgccagaaattggctctcgcataagcgaccgaatttgcagtacccccgttgcaatggaatgacagcgggtatgttaaacaaccccatccggcatggagccaggtggacgttaaatataaacctgaagattaaacatgactgaatcttttgctcaactctttgaagagtccttaaaagaaatcgaaacccgcccgggttctatcgttcgtggcgttgttgttgctatcgacaaagacgtagtactggttgacgctggtctgaaatctgagtccgccatcccggctgagcagttcaaaaacgcccagggcgagctggaaatccaggtaggtgacgaagttgacgttgctctggacgcagtagaagacggcttcggtgaaactctgctgtcccgtgagaaagctaaacgtcacgaagcctggatcacgctggaaaaagcttacgaagatgctgaaactgttaccggtgttatcaacggcaaagttaagggcggcttcactgttgagctgaacggtattcgtgcgttcctgccaggttctctggtagacgttcgtccggtgcgtgacactctgcacctggaaggcaaagagcttgaatttaaagtaatcaagctggatcagaagcgcaacaacgttgttgtttctcgtcgtgccgttatcgaatccgaaaacagcgcagagcgcgatcagctgctggaaaacctgcaggaaggcatggaagttaaaggtatcgttaagaacctcactgactacggtgcattcgttgatctgggcggcgttgacggcctgctgcacatcactgacatggcctggaaacgcgttaagcatccgagcgaaatcgtcaacgtgggcgacgaaatcactgttaaagtgctgaagttcgaccgcgaacgtacccgtgtatccctgggcctgaaacagctgggcgaagatccgtgggtagctatcgctaaacgttatccggaaggtaccaaactgactggtcgcgtgaccaacctgaccgactacggctgcttcgttgaaatcgaagaaggcgttgaaggcctggtacacgtttccgaaatggactggaccaacaaaaacatccacccgtccaaagttgttaacgttggcgatgtagtggaagttatggttctggatatcgacgaagaacgtcgtcgtatctccctgggtctgaaacagtgcaaagctaacccgtggcagcagttcgcggaaacccacaacaagggcgaccgtgttgaaggtaaaatcaagtctatcactgacttcggtatcttcatcggcttggacggcggcatcgacggcctggttcacctgtctgacatctcctggaacgttgcaggcgaagaagcagttcgtgaatacaaaaaaggcgacgaaatcgctgcagttgttctgcaggttgacgcagaacgtgaacgtatctccctgggcgttaaacagctcgcagaagatccgttcaacaactgggttgctctgaacaagaaaggcgctatcgtaaccggtaaagtaactgcagttgacgctaaaggcgcaaccgtagaactggctgacggcgttgaaggttacctgcgtgcttctgaagcatcccgtgaccgcgttgaagacgctaccctggttctgagcgttggcgacgaagttgaagctaaattcaccggcgttgatcgtaaaaaccgcgcaatcagcctgtctgttcgtgcgaaagacgaagctgacgagaaagatgcaatcgcaactgttaacaaacaggaagatgcaaacttctccaacaacgcaatggctgaagctttcaaagcagctaaaggcgagtaattctctgactcttcgggatttttattccgaagtttgttgagtttacttgacagattgcaggtttcgtcctgtaatcaagcactaagggcggctacggccgcccttaatcaatgcagcaacagcagccgcttaatttgcctttaaggaaccggaggaatcatgaccaagtcagaattgatagaaagacttgccacccagcaatcgcacattcccgccaagacggttgaagatgcagtaaaagagatgctggagcatatggcctcgactcttgcgcagggcgagcgtattgaaatccgcggtttcggcagtttctctttgcactaccgcgcaccacgtaccggacgtaatccgaagactggcgataaagtagaactggaaggaaaatacgttcctcactttaaacctggtaaagaactgcgcgatcgcgccaatatttacggttaagttttttactcaaacttgaacgagagaaaagcacctgtcgggtgcttttttcatttctctaatctggaactggaagctgcctcgcagagttttgaacagttttcaccctttcgttaaattcttctgaatatgcctcggggaacgcaaaattcccaccagacaaccgctcaacaaagttgcacactttccataaacagggaggggtgcatgaaaataacgacagtcggtgtatgcataattagcggaatttttccgttgctgattttgccccaattgcctgggacattaacccttgcgtttctgactctcttcgcctgcgtactggcatttatccctgttaaaaccgtccgttatatcgcgctgacgttgctgtttttcgtttggggcatattatcagcaaagcaaattttgtgggcaggagaaaccttaactggcgcgacgcaggatgcaattgttgagatcactgcaactgacggcatgaccactcattacggtcaaattactcatctacaaggtcgacgtatattccctgcgtcaggtctcgtgatgtatggcgaatatcttccgcaagcggtttgtgctggacaacaatggtcaatgaaactcaaagttcgtgcagttcatggccaacttaatgatggcggctttgatagccagcgttatgccattgcccagcatcagccgctcaccggccgttttctgcaggcaagtgtcattgaaccgaattgtagcctgcgtgcacagtatctggcgtcactacaaacaacgctgcaaccctatccgtggaatgcggttattcttggtttaggtatgggggaacggttatccgtccccaaagaaatcaaaaatatcatgcgcgatactggaacggcgcatttaatggcgatatcgggattgcacatcgcttttgcggcgttgctggctgccggactcattcgcagtggacaaatttttctgcctgggcgctggatccactggcaaataccattaattggcggaatctgctgtgctgctttttatgcctggttgacgggaatgcaacctcctgcattgcgtaccatggtggcgcttgctacgtggggaatgcttaagttaagtgggcgacagtggagtggctgggatgtatggatatgttgtctggcggcaattttgctgatggatcctgttgccattctctcgcaaagtttatggctctctgccgctgcggtcgcggcattgatattttggtatcagtggtttccctgtcctgagtggcaactgccgccggtattgcgtgcagttgtttccctcatccatctgcaactgggaatcacacttctgcttatgcccgtgcaaatcgtcatatttcatggcattagtctgacctcgtttattgcaaatctattagcaattcccttggtgacatttatcacggttccgttgatcctcgccgcgatggttgtgcatttaagcgggccgttaatcctggagcaagggttatggtttcttgccgaccggtctttggctttacttttctgggggttaaagagtttgccggaagggtggatcaacattgctgaatgttggcaatggctatcattttccccatggttcttactggtggtatggcgattaaacgcctggcgaacgttgccagcaatgtgtgtggctggaggcttgctgatgtgctggccgctgtggcaaaaacctcgacctgacgagtggcagctgtacatgcttgatgtcgggcaagggctggcaatggtgatagccagaaacggcaaagcgattctctatgacacaggactggcctggcctgaaggggatagtgggcaacaactgattatcccctggctccactggcataatcttgaaccggaaggcgttattctgagccatgaacatctggatcaccggggagggctggattcaatattgcatatatggccgatgttatggatcagaagtccgttaaactgggaacatcatcagccctgtgtgcgtggcgaagcgtggcaatggcaaggattgcgtttcagcgcgcactggcctttacaaggtagcaacgataaaggaaataaccattcctgtgtggttaaggttgatgacgggacgaatagcattcttctaaccggtgatattgaagccccagctgaacaaaagatgctaagccgttactggcagcaagtgcaggcaacattgcttcaggtacctcaccatggcagtaatacctcatcatcgttgccattaattcagcgagtgaatggaaaagtggcactcgcatcggcatcgcgctataacgcatggcgactgccctctaacaaagttaagcatcgctatcaactgcaaggatatcaatggattgatactccacatcaaggtcaaacaacggtcaatttttcagcgcaaggctggcggattagcagcctcagggagcaaattttacctcgttggtatcatcagtggtttggcgtgccagtggataacgggtagaatatgcggctatttcaacaaatgctggttttttgaatgcataacgacaaagatctctctacgtggcagacattccgccgactgtggccaaccattgcgcctttcaaagcgggtctgatcgtggcgggcgtagcgttaatcctcaacgcagccagcgataccttcatgttatcgctccttaagccacttcttgatgatggctttggtaaaacagatcgctccgtgctggtgtggatgccgctggtggtgatcgggctgatgattttacgtggtatcaccagctatgtctccagctactgtatctcctgggtatcaggaaaggtggtaatgaccatgcgtcgccgcctgtttggtcacatgatgggaatgccagtttcattctttgacaaacagtcaacgggtacgctgttgtcacgtattacctacgattccgaacaggttgcttcttcttcttccggcgcactgattactgttgtgcgtgaaggtgcgtcgatcatcggcctgttcatcatgatgttctattacagttggcaactgtcgatcattttgattgtgctggcaccgattgtttcgattgcgattcgcgttgtatcgaagcgttttcgcaacatcagtaaaaacatgcagaacaccatggggcaggtgaccaccagcgcagaacaaatgctgaagggccacaaagaagtattgattttcggtggtcaggaagtggaaacgaaacgctttgataaagtcagcaaccgaatgcgtcttcaggggatgaaaatggtttcagcctcttccatctctgatccgatcattcagctgatcgcctctttggcgctggcgtttgttctgtatgcggcgagcttcccaagtgtcatggatagcctgactgccggtacgattaccgttgttttctcttcaatgattgcactgatgcgtccgctgaaatcgctgaccaacgttaacgcccagttccagcgcggtatggcggcttgtcagacgctgtttaccattctggacagtgagcaggagaaagatgaaggtaagcgcgtgatcgagcgtgcgactggcgacgtggaattccgcaatgtcacctttacttatccgggacgtgacgtacctgcattgcgtaacatcaacctgaaaattccggcagggaagacggttgctctggttggacgctctggttcgggtaaatcaaccatcgccagcctgatcacgcgtttttacgatattgatgaaggcgaaatcctgatggatggtcacgatctgcgcgagtataccctggcgtcgttacgtaaccaggttgctctggtgtcgcagaatgtccatctgtttaacgatacggttgctaacaacattgcttacgcacggactgaacagtacagccgtgagcaaattgaagaagcggcgcgtatggcctacgccatggacttcatcaataagatggataacggtctcgatacagtgattggtgaaaacggcgtgctgctctctggcggtcagcgtcagcgtattgctatcgctcgagccttgttgcgtgatagcccgattctgattctggacgaagctacctcggctctggataccgaatccgaacgtgcgattcaggcggcactggatgagttgcagaaaaaccgtacctctctggtgattgcccaccgcttgtctaccattgaaaaggcagacgaaatcgtggtcgtcgaggatggtgtcattgtggaacgcggtacgcataacgatttgcttgagcaccgcggcgtttacgcgcaacttcacaaaatgcagtttggccaatgatcgaaaaaatctggtctggtgaatcccctttgtggcggctattgctgccactctcctggttgtatggcctggtgagtggcgcgatccgtctttgctataaactaaaactgaagcgcgcctggcgtgcccccgtaccggttgtcgtggttggtaatctcaccgcaggcggcaacggaaaaaccccggtcgttgtctggctggtggaacagttgcaacagcgcggtattcgcgtgggggtcgtatcgcggggatatggtggtaaggctgaatcttatccgctgttattgtcggcagataccacaacagcacaggcgggtgatgaacctgtgttgatttatcaacgcactgatgcgcctgttgcggtttctcccgttcgttctgatgcggtaaaagccattctggcgcaacaccctgatgtgcagatcatcgtaaccgacgacggtttacagcattaccgtctggcgcgtgatgtggaaattgtcgttattgatggtgtgcgtcgctttggcaatggctggtggttgccggcggggccaatgcgtgagcgagcggggcgcttaaagtcggttgatgcggtaatcgtcaacggcggtgtccctcgcagcggtgaaatccccatgcatctgctgccgggtcaggcggtgaatttacgtaccggtacgcgttgtgacgttgctcagcttgaacatgtagtggcgatggcggggattgggcatccgccgcgcttttttgccacgctgaagatgtgtggcgtacaaccggaaaaatgtgtaccgctggccgatcatcagtctttgaaccatgcggatgtcagtgcgttggtaagcgccgggcaaacgctggtaatgactgaaaaagatgcggtgaaatgccgggcctttgcagaagaaaattggtggtatttgcctgtagacgcacagctttcaggtgatgaaccagcgaaactgcttacgcaactaaccttgctggcttctggcaactagttacgccgcggcagcgttcgattgatggagtcatgaatgtcgctgccgcacctctcccttgctgatgcgcgtaatcttcaccttgccgcacaaggcctgttaaacaaaccccgccgtcgagcgtcgttggaggatattccggcaacgatctcccgcatgtccttgctgcaaatcgataccatcaatattgttgcccgtagtccatatctggtgcttttcagtcgtctgggaaattatcctgcccagtggctggatgagtctctggcgcgtggcgaattaatggaatactgggcgcatgaagcctgctttatgccgcgtagcgactttcgtcttattcgccaccgcatgctggcacctgaaaaaatgggctggaaatacaaagacgcctggatgcaggaacatgaggcggaaattgcacagttaattcagcatattcatgataaggggccggtacgttcagccgattttgagcatcctcgtaaaggtgcaagcggctggtgggaatggaagccgcataaacggcatctggaaggtttatttactgccggaaaggtgatggtgattgaacggcgcaacttccagcgcgtttatgatttaacccaccgtgtcatgcctgactgggatgatgagcgcgatctcgtttcgcaaacagaagcagaaatcatcatgctggataacagtgcgcgtagcctgggaatattccgcgaacagtggctggcagattactatcggctgaaacgtccggcactggcggcgtggcgcgaagcgagggctgaacagcagcaaatcattgctgtgcatgttgaaaaattgggcaatctttggctgcatgatgatttgctgccgctactcgagcgagcgctggccggaaagctcactgcaacgcacagcgcggtactttcgccttttgatcctgttgtctgggatcgcaaacgcgcagagcagctttttgattttagctaccggctggagtgctataccccagcgccgaaacgccagtatggctattttgttctgccgttattacatcgtgggcaattagttgggcgaatggatgccaaaatgcatcgccagacaggcatccttgaagttatctctctgtggttacaggaaggtattaaaccaacgacaacgctgcaaaaagggctacgtcaggcgattactgatttcgctaactggcagcaggcaacgcgggtgacattaggatgctgcccgcaaggcctctttactgattgccgcaccggctgggaaatagaccccgtcgcataaatgattatgataagatttatgcattcataacccgatccatctggaggaactatggatcatcgtctgcttgaaatcattgcctgcccggtttgcaacggaaaactttggtataaccaggaaaaacaagagcttatttgcaaactggacaacctcgctttcccgctgcgtgatggcattccagtgttgctggaaacggaagcccgcgtgctgactgctgatgagagtaaatcatgagttttgtggtcattattcccgcgcgctacgcgtccacgcgtctgcccggtaaaccattggttgatattaacggcaaacccatgattgttcatgttcttgaacgcgcgcgtgaatcaggtgccgagcgcatcatcgtggcaaccgatcatgaggatgttgcccgcgccgttgaagccgctggcggtgaagtatgtatgacgcgcgccgatcatcagtcaggaacagaacgtctggcggaagttgtcgaaaaatgcgcattcagcgacgacacggtgatcgttaatgtgcagggtgatgaaccgatgatccctgcgacaatcattcgtcaggttgctgataacctcgctcagcgtcaggtgggtatggcgactctggcggtgccaatccacaatgcggaagaagcgtttaacccgaatgcggtgaaagtggttctcgacgctgaagggtatgcactgtacttctctcgcgccaccattccttgggatcgtgatcgttttgcagaaggccttgaaaccgttggcgataacttcctgcgtcatcttggtatttatggctaccgtgcaggctttatccgtcgttacgtcaactggcagccaagtccgttagaacacatcgaaatgttagagcagcttcgtgttctgtggtacggcgaaaaaatccatgttgctgttgctcaggaagttcctggcacaggtgtggatacccctgaagatcttgagcgcgttcgcgctgaaatgcgctaatttcacttcacgacacttcagccaattttgggaggagtgtcgtaccgttacgattttcctcaatttttcttttcaacaattgatctcattcaggtgacatcttttatattggcgctcattatgaaagcagtagcttttatgagggtaatctgaatggaacagctgcgtgccgaattaagccatttactgggcgaaaaactcagtcgtattgagtgcgtcaatgaaaaagcggatacggcgttgtgggctttgtatgacagccagggaaacccaatgccgttaatggcaagaagctttagtacgcccggaaaagcccgacaactggcatggaaaaccaccatgctggcaagaagtgggactgtccgtatgccgactatttatggtgtgatgacgcatgaagaacaccccggccccgatgtcctgctactggagcggatgcgtggtgtttcggtggaggcaccagcccgaacaccagaacgctgggaacaactcaaagaccaaatcgttgaagccttactggcctggcaccgtcaggacagtcgcggttgcgtcggcgcggtcgacaatactcaggaaaatttctggccctcatggtaccggcaacatgttgaagtgctatggaccacgctcaatcagttcaataacaccggtctgacgatgcaggataagcggatcctgtttcgcactcgcgaatgtctcccggcattatttgaaggctttaacgacaattgtgtgctgattcacggtaacttctgtttacgcagcatgttgaaagattcgcgcagcgatcagttactggcgatggtcgggccgggactaatgctttgggcaccgcgagaatacgaactgttccgactaatggataattctctggcggaagatttgctctggagttacctgcaacgcgcgccagtggcggagtcgttcatctggcggcgttggttgtatgtgttatgggatgaagttgcgcaactggttaataccggacgatttagtcggcgcaacttcgatctggcatcaaaatcactcttgccgtggctcgcctgacgaaccttttagccactgccagatacggccaagcgtttcatagccaacacgatcgctatgcatcaaccagaccggagaagggattgcccgttcccacgggttaagcggcgagtcgatggccaactgattcgccggggctggtagcggatttaacccttcctgctgaaaaaagatcatcgcccgcggcagatgtgatgcggaggtcaccagcaggaaaggggcgtcaccaatcgcctgtttcactgctgcagcttcttcttcggtatcttttggcaaatccagggtgataatttgctcgcgcggcacgcccagcgattgcgcaactctggcacctacttccgctgtactcaccgtattggtttttgctacgcctcccgtgaagatcagttttgatcccggattttcgcgccataagcgaataccttcattcaggcgtggcagactgttattgattaaattagagctcggtgcccactgcgggttccaggtataaccacctccgagcaccacgatatagtccactttttgcgaattattccatgtcggataggtgctttcgatgggacgcagcaggcggtcggctaccggttgcaaactcaataacaagagcgccagccacccaatgctaataaaaatcttcccggttttttgaaaacggctaaaccacagcagcgccaggccagcgccaataatcaacaacatcagcggaagtggcagcaacatattgccaatcacttttttcagtgtaaaaagcatcctttctggttccttttttaaccatatagcaagggatcgccagcgatattacaccagacgggttcattctcgccgtggctgtgacaaaatagcgtctttatcagaaaacgtcttagccaaccggtggagaaagcaatgcaggatcgcaattttgatgatattgcggaaaagttttcccgtaacatttacggcaccaccaaagggcagcttcgacaggctattctgtggcaggatctcgatcgcgtgctggcggaaatgggcccgcaaaaactgcgtgtgctggatgctggcggtggagaagggcagaccgcaatcaaaatggccgagcgtgggcatcaggtcattttatgcgatctttctgcgcagatgatcgaccgcgcaaaacaggcggcagaagcaaaaggtgtgagcgacaacatgcaatttatacattgcgccgctcaggatgttgcttcgcatttggaaacgcccgttgatctgatattgttccatgcggtgctcgagtgggtggctgatccccgcagcgtattgcagaccctctggtcagtgttgcgtccaggcggcgtgttgtcgttaatgttctacaatgcgcatggtttgttgatgcataacatggtcgccgggaattttgattacgtgcaggcgggaatgccgaaaaagaaaaaacggacgctttcgccagattatccacgcgacccggcgcaggtttatctgtggctggaagaagctggttggcaaattatgggtaagacaggcgttcgcgtgtttcatgattatctgcgcgagaaacaccagcagcgcgactgctatgaagcattacttgaattagaaacgcgttattgccgtcaggaaccgtatattaccctggggcgttatattcatgtcaccgcgcgcaaaccgcagagcaaggataaagtatgagtgaattttcccagacagtccccgaactggttgcctgggccagaaaaaatgacttctccatctcgctgccggtagaccgactctcttttctgctggcggttgccacgctgaacggcgagcgtctggatggtgagatgagtgaaggcgagctggtggatgcattccgccatgtgagtgatgcgtttgagcaaaccagcgaaaccatcggcgtgcgcgccaataacgcgatcaacgacatggtgcgtcaacgtctgctgaaccgctttaccagcgagcaggcggaagggaacgcaatttaccgtctgacgccgctcggcatcggcattactgactactacatccgtcagcgcgagttttctacgctgcgtctttctatgcagttgtcgattgtggcgggtgagctcaaacgcgcagcagatgccgccgaagagggcggtgatgaatttcactggcaccgtaatgtctatgcgccactgaaatattcggtagcagaaattttcgacagtatcgacctgacgcaacgtctgatggacgaacagcagcagcaggtgaaggacgatatcgcccagttgctgaacaaagactggcgggcggcgatttccagctgtgaattgttgctttcggaaacttccggaacgctgcgtgaattgcaggatacgctggaagcggcaggcgacaaattgcaggctaatctgttgcgcattcaggatgcgacgatgacccatgacgatctgcatttcgtcgatcgtctggtgttcgatctgcagagcaaactcgatcgtattatcagttggggccagcaatccatcgacttgtggattggctacgaccgccacgtacacaaatttattcgtaccgcgatcgatatggataaaaaccgcgtctttgctcagcggttacgtcagtcggtacaaacctattttgatgagccgtgggcgctaacttatgccaatgccgatcgtctgctggatatgcgtgacgaagagatggcactgcgcgatgaagaagtgactggggaacttcctgaggatctggaatacgaagagtttaacgagatccgcgaacagctggcggcgatcatcgaagaacaacttgccgtgtacaaaaccagacaagtgccgctggatcttggtctggtggtacgcgaatatctgtcacagtatccgcgtgcacgtcactttgacgttgcgcgtattgttattgatcaggcggtacgtcttggcgtagcgcaagcagatttcaccggactgccagcgaaatggcagccgattaatgattacggagccaaggtacaggcgcatgtcatcgacaaatattgaacaagtgatgccggttaagctggcgcaggcgctggcgaatccgttatttccggcgctggacagcgccttacgttcaggacgccatattggcctcgacgaactggataatcatgcattcctgatggattttcaggaatatctggaagagttttacgcgcgttataacgttgagcttattcgcgcaccagaagggttcttctatttacgcccacgttccaccacgctgatccctcgttccgtcttgtcggaactggatatgatggtcgggaaaatcctctgttatctctatctcagcccggaacggctggcgaatgaggggattttcacccagcaggaactgtacgacgaactgctcaccctggccgatgaagcaaaactgctgaaactggtgaacaaccgttcaaccggttcagacgttgaccgtcagaagttgcaggagaaagtacgttcttcgctcaaccgtctgcgtcgtttaggcatggtgtggtttatgggccacgacagcagcaagtttcgcattaccgaatcggtgttccgcttcggagccgatgtgcgtgctggcgacgatccccgtgaagcacagcgtcgcctgattcgtgatggcgaagcaatgccgattgaaaatcatctgcaactcaacgatgaaaccgaagagaatcagccagatagcggagaggaagaataatgattgaacgcggtaaatttcgctcactgacgctgattaactggaacggcttttttgcccgaacttttgaccttgacgagctggtcacgacgctttctggcggtaacggggcgggtaaatccaccaccatggcggcgttcgttacggcgctgatccccgacctgaccctgctgcatttccgtaacactacggaagccggggccaccagcggttcgcgcgataaaggtctgcacggtaagctgaaagcgggtgtctgttattcgatgctcgacaccattaactcgcgccaccagcgcgtggtggtcggtgtgcgtctgcaacaggttgccggacgcgatcgtaaagtggatatcaagccgtttgccattcagggactgccgatgtcggtgcagccgacacagctggtgaccgaaaccctgaacgaacgccaggcgcgcgtgctgccgcttaacgagctgaaagacaagctcgaggcgatggaaggcgtgcagtttaaacagttcaactccattactgattaccactcgctgatgttcgatctgggcatcatcgcgcgtcgtctgcgctccgcatctgaccgtagcaaattctatcgtctgatcgaagcttcgctgtatggcgggatctccagtgccattacccgttctctgcgcgactacctgttgccagaaaacagcggcgtgcgtaaagcgttccaggacatggaagcggcgctgcgtgaaaaccgtatgacgctggaagcgattcgtgtcacccagtcggaccgcgacctgtttaagcatctgatcagcgaagccaccaactacgtggcggcggactacatgcgtcacgccaacgagcgccgtgtccatctcgacaaagccctggagtttcgtcgcgagctacatacttcgcgtcagcaactggcggctgagcagtacaaacacgtcgatatggcgcgtgagctggcagagcacaacggtgccgaaggcgatctggaagcggattatcaggcggccagtgatcacctgaacctggtgcaaaccgcactgcgtcagcaggagaagatcgaacgctacgaagcggatctcgatgagctgcagatccgtctggaagagcaaaatgaagtggtggcagaagccatcgaacgccagcaagagaatgaggctcgtgcggaagctgccgaactggaagtggacgagctgaaaagccagcttgctgactaccagcaggcgctggacgtccagcaaacgcgcgcgatccagtataaccaggcgattgctgcgcttaatcgtgccaaagaactgtgccatctgccggacttaaccgccgactgcgccgccgaatggctggaaaccttccaggcgaaagagctggaagcgactgaaaaaatgctctctcttgagcagaaaatgagcatggcgcaaaccgcgcacagccagtttgagcaggcttatcagctggtggtggcaatcaacggcccactggcgcgtaacgaggcgtgggatgtcgctcgcgaactattgcgcgaaggggtcgatcagcgtcacctggcagagcaggttcagccgctgcggatgcgattaagcgaactggaacagcgtctacgcgagcagcaagaagctgagcgtctgctggcagatttctgcaaacgtcagggcaagaattttgatatcgacgaactggaagccctgcatcaggaactggaagcacgcattgcctctctttccgatagcgtgtctaacgcccgtgaagagcgcatggcactgcgccaggagcaggaacagctgcagtctcgcattcagagtttgatgcagcgtgcgccggtttggctggcagcgcaaaacagtctcaaccagttgagcgaacagtgcggcgaagagtttacctccagccaggacgtcaccgaatatctgcaacagttgctggagcgtgagcgagaggcgattgttgaacgcgatgaagtgggcgcgcgcaaaaacgccgtcgatgaagagatcgaacgtttaagccagcctggcggctctgaagatcagcgtctgaacgcgctggcggagcgttttggtggtgtgctgctgtcagaaatttatgacgacgttagcctggaagatgcgccgtacttctcagcgctgtatggcccgtcacgccacgccatcgtggtgccagatctgtcacaggtaactgaacacctggaaggcttgaccgattgcccggaagatctctatctgatcgaaggagatccgcagtcattcgatgacagcgtgttcagcgttgatgagctggaaaaagcggtagtggtgaaaatcgccgatcgtcagtggcgttattcacgtttcccggaagtgccgctgtttggtcgtgctgcgcgtgaaagccgtattgaaagcctccatgccgagcgtgaagtgctttccgaacgcttcgccacgctctcctttgatgtacagaaaactcagcgtctgcatcaggcgttcagccgctttatcggcagtcatctggcggttgcgtttgagtctgacccggaagcagaaatccgtcaactgaacagccgtcgcgtcgaactggagcgggcgttaagtaatcatgaaaatgataaccagcagcagcgtattcagtttgagcaggcgaaagagggcgttacggcgctgaaccgcattctgccgcgtctcaacctgttggctgatgacagcctggcggatcgcgtcgatgaaatccgcgaacgtctggatgaagcccaggaagccgcgcgttttgttcagcagtttggcaatcaactggcgaaactggaaccgattgtttcggtattgcagagcgacccggaacagttcgaacagttaaaagaagattacgcgtactctcagcagatgcagcgcgatgcccgtcagcaggcgtttgccctgacggaagtggtgcagcgtcgtgcgcactttagctattctgactcggcagaaatgcttagcggtaacagcgatctcaacgaaaaactgcgtgaacgtctggaacaggcggaagcggagcgtacccgcgctcgcgaagcgttgcgcggtcacgcagcgcagttgagtcagtacaaccaggtgctggcttcgctgaaaagttcttacgacaccaaaaaagagctactcaacgatctgcaacgtgaattgcaggatatcggcgtgcgtgctgatagcggggcagaagagcgggcgcgtattcgccgtgacgagctgcatgcgcaactgagcaataaccgttcacgccgcaatcaactggaaaaagcgcttaccttctgcgaagcggagatggacaacctgacccgcaaactgcgcaagctggagcgggattactttgagatgcgcgagcaggtagtgaccgccaaagcgggctggtgtgcggtgatgcgcatggtgaaagataacggcgttgagcgccgcttacaccgtcgtgagctggcttatctctccgctgatgatttgcgttccatgtcggataaggcgttaggtgcgctgcgtctggcggtggcggataacgaacatctgcgcgacgtgctgcgcatgtcggaagatccgaaacgtccggagcgtaaaattcagttcttcgtggcggtttatcagcatctgcgtgaacgtattcgtcaggatattattcgtaccgatgatccggtggaagctatcgaacagatggagattgaacttagccgtctgaccgaagaattaacctcccgtgaacagaaactggcgatcagttcccgcagcgtggcgaacatcattcgcaaaaccattcagcgcgagcagaaccgtatccgtatgctcaaccaggggttgcagaacgtatcgtttggtcaggtgaacagcgtgcgtctcaacgtgaacgtgcgtgaaacgcacgccatgctactggatgtgctctctgaacagcacgagcagcatcaggatctgtttaacagcaaccgtttgaccttctcggaagcgctggcgaaactgtatcaacgtcttaacccgcagattgatatggggcagcgcacgccgcagaccatcggtgaagaactgctggattaccgcaactatctggaaatggaagttgaggttaaccgtggttccgatggctggctgcgcgcagagtctggtgcattgtcgaccggtgaggcgattggtaccggtatgtcgattctggtgatggtggtacaaagctgggaagatgaatctcgccgcctgcgcggtaaagatatctctccttgccgcctgctgttcctcgatgaagcagcgcgactggatgctcgttctatcgccacgctgtttgaattgtgtgagcgtttgcaaatgcaactcatcatcgcagcgccggaaaatatcagcccggagaaaggcaccacctataaactggtgcgtaaagtcttccagaataccgaacacgttcatgtcgtcggcctgcgaggatttgcgccgcaactccctgaaacgcttccaggaactgacgaagcgccttctcaggcgagttaaaattaaggcggcagcaatgccgccttttctttttccgaaaactccgtttctgcactaaaaaagtggcacattacggcgcgcttttctttaaacttctttacattaggttatgtaaaaacgtatcggcgtttatatactgaagataagcctgatgagtaacaggcttgctcgtcatactttcgtgagtattggcgttgtacaggcaagtcgtaaaataacagcctggctattcagagtatgataaaaacagggggcaagggatgttgcttaatatgatgtgtggtcgtcagctgtcggcaatcagtttgtgcctggccgtaacattcgctccactgttcaatgcgcaggccgatgagcctgaagtaatccctggcgacagcccggtggctgtcagtgaacagggcgaggcactgccgcaggcgcaagccacggcaataatggcggggatccagccattgcctgaaggtgcggcagaaaaagcccgcacgcaaatcgaatctcaattacccgcaggttacaagccggtttatcttaaccagcttcaactgttgtatgccgcacgcgatatgcaacccatgtgggaaaaccgtgatgctgttaaagccttccagcaacagctggcagaggtggcgattgccggtttccagccgcagtttaataaatgggtagagttactgaccgatcctggtgttaacgggatggcacgcgacgtggtgctctctgatgcgatgatgggctatctccatttcattgcaaatattccggtcaaaggcactcgctggctatatagcagtaaaccttatgcacttgcaacgccgccgctctcggtgattaaccaatggcagctggcgctggataaaggtcaattgcctacgtttgttgcaggactggcaccgcagcatccgcaatatgcggcgatgcatgaatcgttactggccttactctgtgacaccaaaccgtggccccaactgaccggcaaagcaacgttgcgcccagggcagtggagtaacgacgtaccggcgttgcgcgaaatattgcaacgcacaggcatgttggacggggggccgaaaattactctacctggcgatgacacgccaactgacgcggtagtcagcccatccgctgttactgttgaaacagcagaaactaagccgatggataagcaaacgacgtctcgtagtaaacctgcgcctgccgttcgcgccgcctacgataatgaactggtggaagccgttaaacgttttcaggcatggcaaggattgggggcagatggtgctattggcccggcaacacgtgactggttaaacgtaacgcccgcccagcgtgctggtgtgttggctctcaacatccagcgattgcgcttgctgccaacagagctttctaccgggatcatggttaacattccggcctattcgctggtctactatcagaacggcaatcaggtgctggattcgcgagtcattgtcggtcgccccgatcgcaaaacgccgatgatgagcagtgcccttaacaacgtagtggtaaacccgccgtggaacgtacctccaactctggcacgcaaagatattctgccaaaagtgcgcaacgatccgggatatctcgaaagccatggctatacggtgatgcgcggctggaacagcagagaagcgattgacccatggcaggttgactggtctacaatcacggcctcgaatttaccgttccgcttccagcaggctccaggcccacggaactcgctggggcgctataaattcaatatgccgagttcagaggccatttatttgcatgacacgccgaaccacaatctgttcaagcgtgatacacgcgcattgagctcaggctgtgtacgagtgaataaagcttccgatctggcgaatatgctgttgcaggatgcaggctggaatgacaaacgtatttctgatgcgctgaagcagggtgatacacgttacgtcaatattcggcagtcgattccggtgaatctctactacctgacggcctttgttggtgcagatggtcgtacccagtatcgtacagatatttacaattatgatctgcctgcgcgatccagctcgcaaatcgtatcgaaagcggaacaattaatcaggtaaatgaagtagttcggggaaatcagttgtcgtaataattagcatgattgggggcgattctctgcagcccccgtcactgctggggttgagtcatcttgacgtctgctttacgggcggttaaggtgcctcttgtgcgccagaagtgcatataaacgataacattgacctgtagacttgattatcatggacaaattcgacgctaatcgccgcaaattgctggcgcttggtggcgttgcactcggtgccgccatcctgccgacccctgcgtttgcaacactctctaccccacgcccgcgcattttgacactcaataatcttcataccggagagtcaatcaaagcggagtttttcgatggcagaggctatattcaggaagaattggcaaaacttaaccattttttccgcgattaccgcgcgaacaaaataaagtccatcgacccaggattattcgaccagttgtatcgcctgcaagggttgttaggcacgcgcaaaccggtgcaactcatttccggttatcgttctattgataccaacaatgaactacgcgcccgcagccgtggagtagcgaagaaaagctatcacactaaaggccaggcgatggatttccatattgaaggtatcgcgttaagcaatattcgcaaagccgcgttatctatgcgcgcaggtggtgtaggatattatccacgtagtaactttgtgcatattgataccgggccagcacggcactggtagtaattgcttaacgaaacaggggcagtatgaactatcgtattattccggtcaccgcattctcccagaactgttcattaatctggtgtgaacaaacccgtctggccgcactggtcgatcctggcggcgatgcggaaaaaatcaaacaggaagttgatgacagcggcctgacactgatgcagatcctgctgacgcatggtcatctggaccacgttggcgcagcggcggaactggcgcaacattacggcgtgccggttttcggcccggaaaaagaagatgagttctggctgcaaggcttgcctgcgcaaagtcgtatgtttggtctggaagagtgccagccgctgacgccagatcgttggctgaacgaaggcgataccatcagcatagggaatgtgactttacaggtgttacattgccctgggcatacgccgggtcatgtcgtgttttttgatgatcgggcaaagctgctgatttctggcgatgttattttcaaaggcggagtagggcgcagtgacttcccgcgtggcgatcataatcaactgatttcttcaatcaaagataaattgctgccactgggggatgacgtgatatttattccgggtcacggaccattatccacacttggttatgaacgcctgcataatcccttcctgcaagacgaaatgcccgtctggtaaggcacataaaaaagcccgcttttaatgctggcctggatttctggcaaagtgcgctttgtttatgccggatgcggcacgagcgccttatccggcctacaaaatcgtgcaaattcaaaatattgcaggggacgcgtaggcctgataagcgtagcgcatcaggcaatgttgcgtttgtcatcagtctcagcccgcttttcagcgggcttcattgtttttaatgcttacagcactgccacaatcgcttcgcacagcggagccatgttatctggtgtcatcccggccacatttacgcgaccagaagcaaccgcatatacgccaaactcttcgcgcagacgcagcacttgttcttttgtcaggccactgaaggagaacatgccgttctgtttgatgataaagctgaagtcgcggtttgcgcctttttcctgcagcgtattgacgaacaactgacgcatacgctgaatacgctggcgcatatcagtcagctcttgttcccaaatcgcacgtaacgcatcgttgctcaggatggtggcaacaacagaagcgccgtgtgctggtgggttagagtagttagcgcgaatcgccgctttcatttggctgaatgcgcgatcaacggtttcactgtcggcagcaaccagagtacaagcgccaacacgctcgttgtacaggccaaagtttttagagtaggaactggcaacaatcagctctttatgcatagccgcgaaagcgcgcagtccttcagcatcttcttccagaccacgggcaaaaccctggtaagcgaagtcaaacagcggtaaccagcctttctcaacggagagttgtgccagtgtttgccattgttccagcgtagggtcgataccggttgggttatggcagcagccatggaacagcactacgtcgccagcctgagcttcattcaggctgttaatcagtgcatcgaagtcaagagtgtgattttccgcatcataataagcgtattcacgaacttccagacctgcagagttaaagacgctcttatggttcggccagcttgggttgctcacccacacacgcttaacgctggtattttttgccaggaaatcggcagccacgcgtagtgcgccagtgccccccggagtctgtgccgtgcgagcacgtttgtcattgatcagggcgctacctttaccaaacagcagttcctgagtgcagcgaccaaattcagggatgccgtcaatgccgaggtaatttttggtggtttcattttcgagcagatactgttcagcctttttcacgctggtcagtaccggggttttgcccgtctcatctttatagacaccaatcccgaggttaattttgccgggacgttcatcggcacgaaacagatcggccaggcccagaatcgggtcggcaggagcggcggtaatgttctcaaacatgacgaggttccattatggttacagaagggaagtccgctatcagggtaacgggagatttacaaaattccaactattactgatgaaaacgcaggctgtttttgcaagacgtgagattgctctggaaggtataaaaaaaacaggaccaaagtcctgttttttcggcatttaacaaagaggtgtgctattagaactggtaaacgatacccacagcaacggtgtcgtctgaacctacgcccagtttgttgtcagaatcgatctggttgatgatgtagtcaacataggtggacatgtttttgttgaagtagtaggttgcgcccacttcaaagtagttcaccagatcaacatcaccgataccttctacgtctttcgctttagatttggtgtaagcgatggacggacgcagaccgaaatcgaactggtattgcgcaactaacagaacgtcttgcgttttgttggcgaagccgctggtgtttgtaaatttattagtgatcggcgtagcgttacgggtttcaccgtagttcgctgccaggtagatgttgttcgcgtcgtacttcagaccagtagcccactgttcagcttttttaccgttgccaagaggttgagcttcttgcaggttggtacggtcagctgcaccataagcaccaacgataccaaagccttcgtattcgtagctgatagaaccgccaacaccgtcgccgttagaacggcgtgcagtgtcacgctcgtttttacccaggtactgaacagcgaagttcaggccatcaaccagaccaaagaagttggagttacgataggtagcaacgccgccaacacgaccaacgaagaagtcatcgctgtatgcagtatcaccaccaaattctggcagcatatcggtgtaacccagtgcatcataaaccacaccgtagttacggccgtaatcgaaagaaccaacgtcagcgtatttaagacccgcgaatgccagacgcgttttgttaccagtttgagcgtcagcgccttcagagttgttaccctggaagttatattcccactgaccataaccggtcagatcggaattgatttgagtttcccctttaaaaccaagacgggcataggtcatgtcgccattgccaccgtaactgttttcaccgttacccttggaaaaataatgcagaccaacagctttaccgtacagatctactttgttgccatctttgttatagatttctgcagcgtttgcagtacctgctactaacagagcagggacgatcactgccagaatattgcgcttcatcattatttattaccctcatggttttttttatgacacctgccactgccgtcaataagttctgtcaataaaaatttacggaactattgatgagagtttggtgtctttatgtgtctgcaggcatctttccattcaaactaacgtttcgctaccgtgaaagtgctacaaagataaagatttggtttcaaaaagaaaaaatatgtaaccaaaagtaaaatttaaggaactttgtgaacaccgtcatatttccatagagacgtgatgatatttacagcaattttaatctatttatatgatttccttatatttaaattaactaaacggaaattttgtttctgatggaaactttatcgacctggcacaaaatcttctttcagacatccagaatgccaaaaaatagtatgaaaattgtgctattagctaagaaaaaactaatccgcaataagaatgcggattagtttttgcgcgtaaatgttgcaatgtaatattccgtaacaggatgatcgttatggcggggttgcaaatagattgcttgacttaacaaacagataacttgacagaaaagataaaaaaagagccagcgggcgctggctcttgaagacgctaaattagaagctggcgttacgcggagtacgtgggaacggaatcacatcacgtacgttttgcacgccagttacgtaagcaatcagacgttcaaaaccaagaccgaaacctgaatgcggaacagtaccgtagcgacgcagatcgcgataccaccagtaatcttctttattcaggcccatttccagcatacgctcgtccagcacgtccagacgttcttcacgctgggagccaccaatgatctcaccgatgcccggagccagaacgtccatagccgcaacggttttaccgtcttcgttaaggcgcatatagaacgctttaatatctttcggatagtttttaaccactaccggtgctttaaagtgttcttccgccagataacgctcatgctcagaagagagatcgactccccagtaaaccgggttttcaaacttcctgccgcagttttcgagaatggtcactgcgtcggtataatccacctgcgcaaaatcggcttcaatgaagcgttccagacgtgaaacggcatctttatctacgcgttcagcgaagaatttcatgtcgtcagcgcgttcttcgagaaccgctttgaagacatatttcagcatggcttcagccagacccgcaatatcgttcaggttagcaaacgccacttccggctccagcatccagaattccgccaggtgacggctggtgttggagttttcagcacggaaagtcgggccgaaggtataaattttggacaatgcgcaagcgtaggtttcgccgttcaactggccagatacggtcaggaaagactctttaccaaagaagtctttgtcgaaatccactttgccctgatcgttacgcggcaggttttccagatccagcgtagaaacgcggaacatttcgcctgcaccttcggtatcagatgcggtaatcagtggcgttgaaacccagaagaatccctgctcgttaaagaagcgatgcagcgcctgcgccagcgtatggcgaacgcgcgcgacggcaccaatcaggtttgtgcgcggacgcaggtgagcgacttcacgcagatactcaatgctgtggcgttttgccgccatcgggtaagtgtctggatcttcaacccaaccagcaacttcaaccttgctggcctgaatttcaaattgttgcccctggcccggcgacgccacgactttacccgtcacaatgaccgagcagccggtggtcagacgcaggacgtcttcattgtaattgggcagagaattattgatgacagcctgtacaggatcaaagcaggaaccgtcataaacggcgaggaaggagatgccagcttttgaatctcggcgggtacgtacccatccgcgcacggtgacttcgctgtcaacggctacacggccctggagtacgtcggctacaggcacaacgctcataatattctctctgttaatagtcggaaaaaataaacacttgtccacccgtaaatggggggatacctatgttacctggcatctgcaatcagacaagcagaattcgcaaatgcagcgaaagatttcggaattaaaggtaaaaaaagggagccgattagctccctgatgatattaactggcttttttaatatgcggaaggtcgaacgctttgcgcagcgcccgaacaaacgctttatcatggcagatagttttgccagggctgtcagaaagtttcgccaccggtttaccgttacactctaccaacttaatgacaatattcaggggttttacctgggggatatcgcaggtcaggcgagtcccaataccaaaacttaattgcacgcgggaagagaagtggcggtatagctcaaccgctttgcgtaaatccagattgtcagagaaaaccagcgttttactctgtggatcaattcccagcttttcataatgtgcaatggctttttcaccccattcaaccgggtcgccagagtcatgacgcaggccctgataccgactagcgaactcgacaccgaaatcacgcaggaaagcatccatagtgatgcagtcggttaatgcaatgccaagttggtcgggatactcttccagccaggcagcaagtgcagctcgctggctgttggctagatccgggctgatttgctgatgtgcctggaaccattcgtgtgcctgtgttcccatcggcgtgagggaaagccgacgcgccagatcgtagttgctggtgcccacaaaccaggattcctgttgcagacgcttaacgatggtttcttgtacttcgcgagaaaaacggcgacgggtgccaaaatccatcagatggaagcgcgacatatcaagaccggcggttaacgccgagaagtcgactaatttgctttccagcgtgtcgagggcttgcgcaacgtcggcctgcggtgagcgatagcgatgtaccatttcactgataaccgccagcaaaggaacttcccagaggatgacttcacgccacgggccgcttaaacgaatatccagcttgccattatcgttggacacggtgacttgttccgggttaaagcggaactcgcgtaaccagttaagatagtcggccttaaagaaaggcagggcagaaagccactgatattcatcatcctgcaggcgcaggtgctgcatcgcctgaacctgttcacgaatagcatcggcataaatacccagcagatcgtcacctcggcaacgaaactccgccgcgacatgcacatcgtaatagtgatgaaacacggcttgctgcatatgcaacttataagcatctgtatccagcaacgagtgcagaacaggagaagcgaattgtgtcataggtgcgcagtagcgtcctcgtacaggagcgtttagtacaataaacatcttcaggaactgctggagtataccttgtttcgcaatttattgaaccccgatcacaccatatgccacctttctggtcgatggcattacgcggtgtatgttataaaaatgtagcaataaaggcgtttgtacctgaaaagatgaagattctgcatagcgcgatttacgcaacaggaatagactgaacaccagactctataaaagatgctaaaggttatttatgactcaacagccacaagccaaataccgtcacgattatcgtgcgccggattaccagattactgatattgacttgacctttgacctcgacgcgcaaaagacggtcgttaccgcggtcagccaggctgtccgtcatggtgcatcagatgctccccttcgtctcaacggcgaagacctcaaactggtttctgttcatattaatgatgagccgtggaccgcctggaaagaagaagagggcgcactggttatcagtaatttgccggagcgttttacgcttaagatcattaatgaaataagcccggcggcgaataccgcgctggaagggctttatcagtcaggcgatgcgctttgcacccagtgtgaagccgaaggtttccgccatattacgtattatctcgaccgcccggacgtgctggcgcgttttaccaccaaaattattgccgataaaatcaaatatcccttcctgctttccaatggtaaccgcgttgcgcaaggcgaactggaaaacggacgccattgggtacagtggcaggacccgttcccgaaaccgtgctacctgtttgcgctggtggcaggcgactttgatgtactgcgcgatacctttaccacgcgttctggtcgcgaagtagcactggagctgtacgtcgatcgcggcaaccttgatcgcgcgccgtgggcgatgacctcgctgaaaaactccatgaaatgggatgaagaacgctttggcctggagtatgacctcgacatctatatgatcgtcgcggtggatttcttcaatatgggcgcaatggagaataaggggctgaatatctttaactccaaatatgtgctggcccgcaccgacaccgccaccgacaaagattacctcgatattgaacgcgttatcggccatgaatatttccataactggaccggtaaccgagtgacctgtcgcgactggttccagctcagcctgaaagaaggtttaaccgtcttccgcgatcaggagttcagctctgaccttggttcccgcgcagttaaccgcatcaataatgtacgcaccatgcgcggattgcagtttgcagaagacgccagcccgatggcgcacccgatccgcccggatatggtcattgagatgaacaacttctacaccctgaccgtttacgagaagggcgcggaagtgattcgcatgatccacaccctgcttggcgaagaaaacttccagaaagggatgcagctttatttcgagcgtcatgatggtagtgcagcgacctgtgacgactttgtgcaggcgatggaagatgcgtcgaatgtcgatctctcccatttccgccgttggtacagccagtccggtacaccgattgtgaccgtcaaagacgactacaatccggaaaccgagcagtacaccctgaccatcagccagcgcacgccagccacgccggatcaggcagaaaaacagccgctgcatattccgtttgccatcgaactgtatgataacgaaggcaaagtgatcccgttgcagaaaggcggtcatccggtgaattccgtgctgaacgtcactcaggcggaacagacctttgtctttgataatgtctacttccagccggtgcctgcgctgctgtgcgaattctctgcgccagtgaaactggaatataagtggagcgatcagcaactgaccttcctgatgcgtcatgcgcgtaatgatttctcccgctgggatgcggcgcaaagtttgctggcaacctacatcaagctgaacgtcgcgcgtcatcagcaaggtcagccgctgtctctgccggtgcatgtggctgatgctttccgcgcggtactgcttgatgagaagattgatccagcgctggcggcagaaatcctgacgctgccttctgtcaatgaaatggctgaattgttcgatatcatcgacccgattgctattgccgaagtacgcgaagcactcactcgtactctggcgactgaactggcggatgagctactggctatttacaacgcgaattaccagagcgagtaccgtgttgagcatgaagatattgcaaaacgcactctgcgtaatgcctgcctgcgtttcctcgcttttggtgaaacgcatctggctgatgtgctggtgagcaagcagttccacgaagcaaacaatatgactgatgcgctggcggcgctttctgcggcggttgccgcacagctgccttgccgtgacgcgctgatgcaggagtacgacgacaagtggcatcagaacggtctggtgatggataaatggtttatcctgcaagccaccagcccggcggcgaatgtgctggagacggtgcgcggcctgttgcagcatcgctcatttaccatgagcaacccgaaccgtattcgttcgttgattggcgcgtttgcgggcagcaatccggcagcgttccatgccgaagatggcagcggttacctgttcctggtggaaatgcttaccgacctcaacagccgtaacccgcaggtggcttcacgtctgattgaaccgctgattcgcctgaaacgttacgatgccaaacgtcaggagaaaatgcgcgcggcgctggaacagttgaaagggctggaaaatctctctggcgatctgtacgagaagataactaaagcactggcttgataaataaccgaatggcggcaatagcgccgccattcggggaatttacccctgttttctcaggcgagtttcagattcaccacgttgcatcacccgttgcaacacctccgcttccagctccgctaatcgcaccgaccctaatcgacgcggacgggggatatccactgtcaaatccagaccaatttttccctcttcaattaacagcacccggtcagccatcgctaccgcttcgctcacatcatgcgtcaccaacagtacggtaaagccgtgctcctgccaaagtgacacaatcaaatcctgcatctcgagtcgcgttaaggcgtccagcgccccgagcggttcatcaagcaacaataatcccggtcgatgaatcaacgctcttgccagcgccactcgctgtttctgcccgccagaaagtgcggcaggccattcccctgcgcgattctccagtcctaccgcagccaacgctcgacgtgcggcatcgcgccactggcctttaaggcctaacccaacgttatcaatcaccgatttccacggtagcagacgcgcatcctgaaacatcattcgcgtgtcttcctgaatttcagccagcggtgtggtgcccgctaacacatcgcctgcggttggcgtttccagacctgccagcaggcgcagcagggtacttttgccaccaccgctgcggcccaccaccgccacaaactgacctgccggaatatgtaaatccagttggttcaggacgatattttccgcgtaatgtttgcttactgcattgagcaacaatggcgtgccctggttcagacgagcagtattcataccgtggcctccttcaaatgataagccgggttccagcgcaaccagaggcgctctaacagctgcgcgctgacgtcagccagtttgccgagcagggcgtaaagaataatagcgactaccaccacgtccgtttgcaaaaactcccgcgcattcatcgccagataaccaatgcctgaattggcagaaatggtttcggcaacaatcagcgtcagccacatcaggcccaacgcaaaacgcacgccgaccataattgagggcagggcaccaggcaggatcacatggataaacagcggtatgccggataatccatagctacgcgccatctccaccaacccgcgatcgatattacggatgccatgccaggtgttgatataaatggggaatagcgtaccgagcgccaccagaaagatttttgcggattcatcaatgccaaaccacaaaatcaccagcgggatcagcgccagatgcggcacgttgcgcaacatctgaattgaggtatccagcagccgttctccccagcgagatagcccgctaatcagtcccaaaatcaaccccagcgatccgccaattgaaaagccaatcagcgcccgccaggagctgatcgccagatgctgccacagttcgccgctggcggagagcgtccagaacgccgtcaccactccttccggtgaaggcaaaatacgcgtcgacagccagccaaccgaggaggccagttgccacaccgccacgatgcccaccggtaaaaaccagggggcaacgcgcaataaccacttcttcactggcgttgccattatttcttccttagctttgcgcgactttacgggggataaaatcattcgccaccgcttcgccttgcggattcagcggctgcggctggggaatttccgggatggcgacatccagaagcgggaacagcaactcgccaacccgatacgcttcttccagatgcggatagcccgaaagcacaaaactgtcgatgccaagcgcggcatattcgttgattcgcgcagcgaccgtaggaccatcgcccaccagcgccgtcccggcaccgccgcgcactaagccaacgcccgcccataaattggggctgatctccagattgtcgcgcttgccgttatgtaacgccgccattcgctgttgccctacggaatccgtccgggcgaatgcggcctgtgctttggcgatagtttcatcatcaagatgcgagattaaccgctcggcggcctgccacgcttcgtcgttagtttcacgaacaatcacatgcagacgaataccgaaacgaattttgcgtccatgcgcggcagctttcgcccgcacttgttcgattttctctttaaccagttccggcggttcgccccaggtgaggtagagatcaacctgttctgccgccagctcctgggcgacatctgacgatccgccaaagtaaagtggcggatacggctgttgaatcgccgggaagagcagttttgctccgcgcacatgaatatgtttaccgttgaaatcgacggtttctctctgcaataaacgccgccagacctgggtaaattccgccgaggcttcgtagcgctcgctatgatcaaggaacactccgtcgcctgccagctcttgtggatcgctgcctgtgaccaggttaaacaacgcacgtccatttgagagacggtcaagcgtggcggcctggcgggcggcaacggtaggtgaggttacgctgggacgcagggcgacaagaaacttcagccgctgcgtcaccgggatcatcgatgcggcaaccagccacgcatcttcgcaggagcgccccgttggaattagcacaccggtatagccaagacgatccgccgcttgcgcaatttgttgcagataaccgtgatcaaccgggcgtgaaccttcttccgttcccagataatgcccgtcaccgtgggtcggtaaaaaccagaacatattcagactcataattgttttccttccagttgagtgggctgccagatgcgctggcgaatatcgacttttttcggcaccagacgattttcataaaacagatctgccgtttgctgctgtaaggcggcaacctcggcgttaaccggtttgatggtggtaggagggcgatgatctaagtaagaggcaatcaccggtgccggtaagcccatcgtttttgccagtaaagcgatgctttgctcgcgctggctgcgggttaacgcatcggcctcactaaaggttgccagtacgccctgaataaaagcgccgtttttttctgcatagggacgagctgccagataaaacgatccagtttgattgagatcggtgccgtctttcagcacccgcacgccgccctgtaataatgcagcagagtagtagggatcccagatagcccaggcgtcaacgttaccttgctggaacgcggcgcgggcatcagcgggcgtcaggtaagtgggttggatatcggtaaacttaagtccggcctgacgcagtgcacgcagtaaaaggttgtgtgaactggaacctttctgaaaggcaactttgtgacctttaagatcggctacggttttgatcgggctgttttctgccaccagaatcacttcggctttgggcttcggtggctcgacgcccacgtacaccaaatcagccccggcagcctgggcaaagattggcggaatatccccggtactgccgagatcaatactgccaacgtttaacgcttccaacatttgcggacccgcggggaactccacccaggagatttttgattccggatagcgtttttccagtaactggtggctttttgccagcaccataccaatactgcctttctgatagcctatacgtaacgcttcaggcgaggattctgcagcaaccgcaaaagtagagacgctaagcaatcccgccagcgccagtttaatgatgttacgcatgggcattacctcgcagagacagaaggtcaggaacctgaacatcgcggcggtgcaatgcctgccagaaagtttctagcgcggtatcaagacgggtttgcagatttggcgtgaactggggtctgtgatggtaatcaattacttgtgagtcatcggcaaacacgccgtgcaggatctcctgagctttcagtgcgcttaaaactggtttaagggcataatcgaccgccagcagatgggccacggtaccgcccgtcgccagcggtagcaccactttgccttgcaaagcgcgttctggcagcaggtcgagcagggttttcaacgcaccggaataggcggctttatacacaggcgtggcgacaatcagcccatcggcctgttgcagctgttcggtgaaggtcttgagtgccggactatcgaaacgagcataaagtagatcttccggggcgaagttttgcagattccagtgataaacctctacatccaggccatttagtttttcccgcgcatattccagcaaggagctggagcgagaaggaaagcgaggactacccgccagggtgatgacacgcatactctctccttataaccaattgttctttttttgttaacattgataacaattcggtcagtctgtcggagagacaagaaaattccaaatataaattttgtgtatctttttctgaaaataaactaaagaaagggctttatatatcacgcatatttatttattggatagtcattagatgttgaatcaatgaattactcgttcagttaatatttaaatattcatgaaatctataaattaaagatttgtcacttattggatttagtatgcttgatttaaatggcggacaattattgttattattaagtctaatgtcatttaaaggcattatcatatttacgaagagatcaggatgataacgatgaaaaaaagtgtattgacggcgtttataactgtggtatgtgcaacgtccagcgttatggctgctgatgataatgctatcacggatggctcagtaacatttaatggtaaagttattgctccagcttgtaccctggtagctgcgacgaaagattccgtggtgactttgccagatgttagtgccacgaagttgcaaaccaatggtcaggtttctggcgtgcaaattgatgtgccaattgaattaaaagattgtgatactaccgtaacaaaaaatgcaacgttcacctttaatggcactgcggatactactcagattacagcgtttgctaaccaggcctcatctgatgctgctacaaacgtggccctgcaaatgtatatgaatgatggtacaacggccatcacgccagacacagaaaccgggaacattttgttgcaggatggagatcagacgttgacttttaaagttgattatatcgctacggggaaagcgacttcaggtaatgtgaatgcggtaacaaatttccatattaactattattaatagaactcattaattgttttattaattagtacccctccagtgttctggaggggatattcatattttttaagagtgactatttatgaaaacttgcataacaaagggaattgtgaccgtaagtttaacggcaatattactcagctgctcatccgcatgggcggcaggtaaaggcgggattggacttgcagcaacacgtcttgtttattcagaaggtgaagagcaaatttcactgggtgtacgtaacaccagtccggatgttccttatcttattcagtcatgggtgatgaccccagataataaaaaatcagcagactttattattacaccaccgctatttgtgctgaatccggcaaatgagaatctgttacgcattatgtacattggagcgccgttggcgaaagacagagaaacccttttcttcactagcgtacgggcagtcccttcaacaacgaagcggaaagagggaaataccctgaagattgccacacaaagcgtcatcaaacttttctggcgaccaaaaggtttagcgtatcccttaggcgaggctccggcgaaactgcgttgcacttcgtcagctgacatggttacggtcagtaacccaacaccttatttcattaccctgacagacctgaaaataggtggaaaagtagttaaaaatcaaatgatttccccctttgataaataccaattttctctgccaaagggggccaaaaatagcagcgtaacgtatcgaaccatcaatgactacggggcggaaacgccgcaactcaactgtaaatcgtaagccgtcttcagttaagagagcgagatgtatagaactcatcgacaacacagcctgttaagctctggtggagtgccatcgtttattggtgggctggtggtgtttgtgtcggcagcgttcaatgcacaagctgaaacctggttcgatcctgcttttttcaaagatgatccctcaatggtggccgatttgtctcgtttcgaaaaaggacaaaaaataacgccaggggtttatcgtgtcgatattgttctgaatcagacaattgtagatacgcgcaacgtcaattttgttgagataacgccagagaaggggattgccgcctgtttgacgactgaaagcctggatgcaatgggtgttaatactgatgcgtttccggcttttaaacaactggacaaacaagcgtgtgtgccattggcggagattattccggatgccagcgtaacgtttaatgtgaataaactccgtctggaaatttcagtaccgcaaatcgccatcaaaagtaatgcccgtggttatgtcccccctgaacgttgggatgaagggatcaacgcgctattactgggatattcgtttagcggggctaacagtattcatagcagcgcagacagtgattctggcgacagctattttctgaatttaaacagtggcgttaatttaggcccatggagattgcgcaacaattcaacatggagtcgtagtagtggccaaaccgcagaatggaagaatctcagcagctatttgcaacgggcggttattcctctgaaaggcgaactgaccgtaggtgatgattatactgcaggcgattttttcgatagtgtcagctttcgtggtgtgcagctggcgtcagatgacaacatgctgccagacagcctgaaagggtttgcgcctgtggtgcgtggtatcgccaaaagcaatgcccagataacgattaagcaaaatggttacaccatttaccaaacttatgtatcgcctggtgcttttgaaattagtgatctctattccacgtcgtcgagcggtgatttgttagttgaaatcaaagaagcggacggcagcgtcaatagctacagcgtaccgttctccagtgtgccattactccagcgtcaggggcgaatcaaatacgcggtgacactggcgaaatacagaaccaatagtaatgaacagcaggagagcaaatttgcccaggccacgttgcagtggggcggaccgtggggaacgacctggtatggtggtggacaatatgctgaatattaccgtgccgccatgtttggtctgggatttaacctcggcgatttcggagcaatttcgttcgatgcgacccaggcgaagagtacgctagcagatcaaagcgaacataaaggtcagtcatatcgttttctgtatgccaaaacgctcaaccacttgggcactaactttcaattgatgggctatcgctattcgacgtcgggtttctacaccctttccgacaccatgtataaacatatggatggctacgaatttaatgacggtgatgatgaagatacgccgatgtggtcgcgttattacaatttgttttacaccaaacgtggcaaactgcaggtcaatatctcccagcaattaggcgagtacggttcgttttatttaagtggtagccagcaaacttactggcatacggatcaacaggatcggctattacagtttggctacaacacgcaaattaaagatctttcgctggggatttcctggaactacagtaagtcccgtggtcaacctgatgctgatcaggtgtttgctctaaatttttccctgccgctcaatctgttgctccccagaagtaatgatagctataccaggaaaaaaaattacgcctggatgacctctaacaccagtatcgataacgaagggcacactacacaaaacctgggtttaacggagacattactcgatgacggtaacctgagctacagcgtgcaacagggatataacagcgaggggaaaacggctaatggtagcgccagcatggattacaaaggggcgtttgcggatgcccgagtgggctacaactacagcgataacggcagtcaacaacaactgaactacgctctttcaggcagtttagttgcccattcacagggcattaccctggggcaatcgctgggggaaactaacgttctgattgcagcaccaggcgcagagaatactcgtgtggcgaacagcaccgggctgaaaactgactggcgcggatataccgttgttccttatgccacttcttatcgggaaaatcgaatcgcacttgatgcggcgtcgttaaaacgtaacgtggatcttgaaaatgcagtagtcaacgtggttcccaccaaaggggcgttggttctggcggagttcaatgcccatgcgggtgcaagggtattaatgaaaacatcaaagcagggtataccgctgcgttttggcgcgatagcgacgctggacggcgtacaggctaatagcggcataattgatgatgatggctcgctctatatggcgggtttaccggcgaagggaacaataagcgtgcgctggggcgaagctcccgatcaaatttgtcatatcaattacgagcttaccgaacaacaaattaactctgcgattacgcgaatggatgccatatgcagataatctttggagaaaaatgcgtgtcattactacgactattttttgccgccgtcttaatgttatggtgcgctcaaaccgctgcttatagcgggcagtgtcatactactcaggggaatccgtatattggcgtcaattttggcgttaaaaccctggaggaagaagcaaatacggcaggggtagttaaagacaaattttatcagtggaacgaatcgaatgattattatgtttcctgtgattgcgataaagacaatgtcagaagtggccgatgggcattcgccgcggattcaccgttagtctatttaggcgacaactggtacaaaattaatgactatcttgccgccaaagttttattgcaggttaaaggcagttctcctactgcggttcctttcgaaaacgtgggcacagggggggatacccgatggcatatttgcgaccctggcggtcaacgtttaggtgggcagggggcaagcggtaatagcggtagcttttccctgaaaatattgcagccgttcgttggctcggtcgtcattcctcctatggcgctggcgcgattatatgaatgctacaacatacccgcaggtgattcctgcacgactacaggtacaccggttttagtgtattacctgtctggtacgatcaattcacttggctcatgttccgtcaatgccggagagacaattgaagttgatttaggtgatgtcttcgctgccaatttccgtgttgtagggcataaacctcttggggccagaacggcagaacttgcaattccagtcaggtgtaacacgggaaacgcgggattagttaatgtcaacctgagtctgacggcaaccacagaccccagctatccccaggcgattaagacgtcacgtcctggcgtgggcgtggtggtgaccgatagccagaacaacattatttcccctgctggtggaacattaccgctctctattcctgatgatgcagacagtatcgcgcgaatgaatgtctatccagtcagcacgacaggtgtaccaccagaaaccgggcgatttgaagccacggcaacggtgagaataaattttgattaacgcgtgaacgtatgaagaaaaaaacgatatttcagtgcgttatcttgttctttagcattcttaacatccatgtcgggatggctgggcctgaacaagttagtatgcatatttatgggaatgtggtcgatcagggctgtgatgtcgccaccaaaagtgcattacaaaatattcatattggtgattttaatatcagtgattttcaggccgcgaataccgtaagcactgctgctgatttgaatatcgatatcaccggttgtgccgctggtattactggcgcggacgtcctttttagcggcgaggctgacacccttgcgccgacactgctcaaactaactgacacaggcggaagcggtggtatggcaacggggattgccgtgcaaattcttgatgcgcaaagtcagcaagaaatcccgctcaatcaggtccagcctcttacgcccttaaaagccggggataacacactcaaatatcaacttcgttataagtccacaaaggcgggagcaacgggcggtaatgcgacggcggttctctattttgatctggtttaccagtgaaggagtgatgttgaaacggataatctggattctgttcttattgggattaacgtggggctgtgagctatttgcccatgatggcacggtcaacattagcggatcgtttcgccgtaatacatgcgtgctggcacaggatagcaagcaaatcaatgtgcagttaggcgatgtctcgctgacacgtttttctcatgggaattatggcccggagaaatctttcatcattaatttgcaggattgcggaacagatgtcagcacggttgacgtcaccttttcaggaacccccgacggagtgcagagcgaaatgttgtccattgaaagtggtacggatgcagccagcgggctggcaattgcgattctggatgatgcgaagatattgattccgcttaaccaggcgagtaaagactacagcctacatagcggtaaggtgccattaactttttatgcgcaattgcgacctgtcaatagcgatgtgcagtcgggtaaagtgaatgccagcgcgacatttgtacttcattatgactaatacgtggaacagattggcgctcttgattttcgccgttttatcgctgctggtggcgggtgaattgcaggcaggagtggtggtcggcggaacgcgatttatctttccggcagacagagaatcgatatctattttactgactaataccagtcaggaatcctggcttattaacagtaaaatcaaccgcccaacgcgttgggccgggggggaagcgtcgacagtgccagcaccattactggccgctccgccacttattctcctgaagcccggtacgacaggcacgttgcgcttgctgagaacggaaagcgacatcttgcctgtggatcgcgaaacgctatttgagttaagcattgccagcgtgccatccggcaaagttgaaaatcagagcgtaaaagtggcgatgcgctcggtatttaaactgttctggcgacccgaaggtttgccgggcgacccgctggaagcttatcaacaattacgctggacacggaattcgcagggtgtacaactcactaacccaacgccttattacattaacctgattcaggtgagtgtaaatggtaaagcgttaagtaatgtgggagttgtgccgcctaaaagccagcgtcagacaagctggtgtcaggcaatcgcaccgtgtcatgtcgcctggcgggcgataaatgattacggcgggttgagtgcaaagaaggagcaaaatctgccctgaaacaggttcggaaaacgtttgcgttttttttgccgcaggtcaattcccttttggtccgaactcgcacataatacgcccccggtttgcacaccgggaatccaggagagttcatgtactaccccttcgttcgtaaagcccttttccagctcgatccagagcgcgctcatgagtttacttttcagcaattacgccgtattacaggaacgccgtttgaagcactggtgcggcagaaagtgcctgcgaaacctgttaactgcatgggcctgacgtttaaaaatccgcttggtctggcagccggtcttgataaagacggggagtgcattgacgcgttaggcgcgatgggatttggatcgatcgagatcggtaccgtcacgccacgtccacagccaggtaatgacaagccgcgtctctttcgtctggtagatgccgaaggtttgatcaaccgtatgggctttaataatcttggcgttgataacctcgtagagaacgtaaaaaaggcccattatgacggcgtcctgggtattaacatcggcaaaaataaagatacgccagtggagcagggcaaagatgactatctgatttgtatggaaaaaatctatgcctatgcgggatatatcgccatcaatatttcatcgccgaataccccaggattacgcacgctgcaatatggtgaagcgctggatgatctcttaaccgcgattaaaaataagcaaaatgatttgcaagcgatgcaccataaatatgtgccgatcgcagtgaagatcgcgccggatctttctgaagaagaattgatccaggttgccgatagtttagttcgccataatattgatggcgttattgcaaccaataccacactcgatcgttctcttgttcagggaatgaaaaattgcgatcaaaccggtggcttaagtggtcgtccgcttcagttaaaaagcaccgaaattattcgccgcttgtcactggaattaaacggtcgcttaccgatcatcggtgttggcggcatcgactcggttatcgctgcgcgtgaaaagattgctgcgggtgcctcactggtgcaaatttattctggttttatttttaaaggtccgccgctgattaaagaaatcgttacccatatctaattatttcttcgaattcctctttataagataatcagggctttattttcagccctggttgttttatattcatcgctgttgcttatttagacattttgtacttttattgttgaggttattaagcgaagcgacaatggattgtgttgctgcggttttatagggtaggggagaggcagatgcgaattaaaccagacgataactggcgttggtattacgatgaagagcacgatcgaatgatgctcgatttagccaatggtatgctatttcgctcacgttttgcgcgcaagatgttgactccagatgccttttctcccgcaggcttttgcgttgacgacgccgcgctctatttctcttttgaagaaaagtgccgcgattttaatttatctaaagaacaaaaagccgaactggtgctgaatgcactggtagcaattcgctatctcaaaccgcaaatgccgaaaagctggcattttgtttcccatggtgaaatgtgggtgcccatgccgggcgatgcggcctgcgtttggttgagcgatactcacgagcaggtcaatttgctggtcgttgaatctggcgaaaatgccgcactatgcctgctggcacaaccctgcgttgttattgcgggtcgcgcgatgcagttgggcgacgccattaaaatcatgaacgacaggctgaaaccgcaggttaatgttgacagcttcagcctcgaacaggcagtctaacgcgccaacttaagtgcagtcttcggtacacagctacagcaaagaatggtgccatcatcgcccattgctgattttttcagcggcgtgacttcgccttctaaaagctgaacacggcaacttccacaaatgcccgcgcggcaagaataagggatacgaattccctgattttctaattgctccagcaacacctgttggttatttccacgaaatgcctgtccctgccagtcaatatctacatttgcgtccggttgttgcgtgatgttggcggtatcatcagcggcagctgcgccgtaaatttttgccggagccgttgccagaatttccacctcatcgccaacgcgaatcacgccgctattacgggcaattaaattctgaccaaaatcgacatcgccgttatcctgggcagtgcggaaagattgcaatgtttttaatggttcgcctgccggatgtttttgccctttttctgggctgacggtggtgaaaatacagcggctacaaggtttaaccacatcaaacaccacatcaccaatgcgaatcactttccagcgatcttcttcccaggctgacgcgccggaaaccaccagattggggcggaattgctccatttttacactggccggacaacgttgttggagatcacgtaacgaggcttcgttagcaagaaggtaaggatagccatcagcaaatgacagaggtacagtgttgtggcgtttcacgcgccgggtcatttgtggccccacccagcgtaattgcacttcgcgggagaaaaatccacttagccatttgttgatcgcgtctggcgcaattcgcgcggtaaaatgtgtgccccaaacttcggttggtgcgtcttgtgtggcgaaatcagcaaaacgaacatatgcgctactgccatctggtgcggtgagatgcaagccatcatgcacaggtgaaggagtaaaccgtaccatctggggaaactggcgagcggtaataaacgtaccgtcaggttccgtgatcataaagatgcgatcgaaggccagaccactgacatctgccagagcatgtgtaagaccaatgccgcgcatcgatttaacaggatgaataaaaagccggattaatgtcgccacggtgcggtcctcaaatgaaaataagccctcaactttatgacatgacgcgcttattagctataatgcgcaacaattttcttagcgcctgtcccattaggctattttatttgtcagtttggccctgggttatgctcgaaatcctcacgtacttgtgtacgctccggtttctccgcgctgtccatgtccagactgactgcaacaattacgcctactgcggtaggctcttagagtaaaagtgacgatatgaattctctgtttgccagtacggcccgtgggctggaagagctgttaaaaactgaactggaaaacctgggggccgttgaatgccaggtggttcagggtggggtccatttcaagggcgacacacggcttgtttaccagagcctgatgtggagccgcctggcctcgcgtattatgttgccgctgggcgagtgtaaggtttacagcgatttagacctctatctcggtgttcaggcgatcaactggacagagatgtttaatcctggcgcgaccttcgctgtccacttcagtggtttgaatgacaccatccgcaacagtcagtacggcgcgatgaaagtgaaagacgcgatcgtcgatgctttcacgcggaaaaatctgccgcgtccaaatgttgatcgcgatgcgccggatatccgcgttaacgtctggctgcataaagaaaccgccagtatcgctcttgatctgagtggtgatggtttacatctgcgtggctatcgcgatcgtgctggtattgcgccgatcaaagaaaccctggcagccgctattgtgatgcgatccggctggcagccaggaacaccgctgctcgatccgatgtgtggttccggtacgttgctgattgaagcagcgatgctggcgaccgatcgcgcaccaggcttgcaccgtgggcgttggggctttagcggctgggcgcagcatgatgaagctatctggcaggaagtgaaagcggaagcgcaaactcgcgcccgtaaaggcctggctgagtatagctctcatttttacggttcggacagcgacgcacgggtgattcaacgtgcacgcactaacgcccgtcttgcggggattggtgaactgatcacctttgaggtgaaagatgtcgcgcaactgaccaatccgctgccgaaagggccgtacggcacagtgttgagcaacccgccatacggggaacgtctggacagcgaaccggcgctgattgcgctgcatagcctgctgggtcggatcatgaaaaaccagtttggtggctggaatctctctttgtttagtgcctcgccggatctgctaagctgcttgcagctgcgtgcagacaaacagtacaaggcgaaaaacggcccgctggactgcgtacagaaaaattaccacgttgccgaaagcactccagacagcaaaccggcgatggtagcggaagactacaccaaccgcctgcgtaagaacctcaaaaaattcgagaagtgggctcgccaggaagggattgaatgttaccgcctgtatgacgccgatctgccagaatataacgttgccgttgaccgttatgccgactgggtggtggtgcaggagtatgcgccgccaaaaactattgatgctcacaaagcgcgtcagcgtctgttcgatattatcgctgcaaccatttcggtactggggattgcgccaaacaaactggtgctgaaaacccgtgaacgccagaagggcaaaaaccaataccagaaactgggcgagaagggcgagtttcttgaagttaccgaatataacgctcacttgtgggtgaacctgacggattatctcgatactggtctgttcctcgatcaccgcatcgcccgtcgtatgctcggtcagatgagcaaaggcaaagatttcctcaacctgttctcttataccggcagcgccaccgtgcatgcgggattaggcggtgcacgcagcaccaccaccgtggatatgtcgcgtacttatctggaatgggcagaacgcaacctgcgtctgaatggcctgaccgggcgtgcgcatcgcctgattcaggccgattgcctggcgtggctgcgtgaggcaaatgaacagttcgatctgatctttatcgatccgccaaccttctctaactcaaaacgaatggaagatgcgtttgatgttcagcgcgatcatctggcgctgatgaaagatttgaaacgtctgctgcgtgcaggtgggacgatcatgttctcgaacaacaaacgtggcttccgtatggatctcgacggcctggcaaaactgggactgaaagcacaagaaattacgcaaaaaacgctctcccaggatttcgcccgtaaccgccagatccacaactgctggctgattaccgcagcctgaaaggaatagtaatgtcattaatcagtatgcatggcgcatggctgtcgttcagcgacgcgccgcttctcgataacgcagaactgcatatcgaagataacgaacgtgtttgtctggtgggccgcaacggcgcaggcaaatcgacgttaatgaaaatcctcaaccgtgaacaagggctggatgacggtcgcattatttacgagcaagatttgattgtagcgcgtctgcaacaggatccgccgcgtaacgttgagggtagcgtttatgatttcgttgccgaaggcattgaagaacaagcggaatatctgaaacgctatcacgatatttcgcgcctggtgatgaacgacccgagcgagaaaaatctcaacgaactggcgaaggttcaggaacagctggatcaccacaacctgtggcagctggaaaaccgcatcaacgaagtgctggcgcaactggggttagatcctaacgttgcgctgtcgtcgctttccggcggctggttgcgtaaagcggcattaggacgcgcgctggtgagtaatccgcgcgtgctgttgcttgatgaaccgacaaaccacctggatattgaaaccatcgactggctggaagggtttttgaaaactttcaacgggacgattattttcatctcccacgaccgttcgtttatccgcaatatggcgacgcgcattgttgatctcgatcgcggcaagctggtgacctatccagggaattacgaccagtacctgctggaaaaagaagaagccctgcgcgtggaagaattacaaaatgccgagttcgatcgcaaactggcgcaggaagaggtgtggatccgccaggggatcaaagcacgccgtacccgtaatgaaggccgcgtacgcgccctgaaagcgatgcgtcgcgaacgtggtgaacgtcgcgaagtgatgggtaccgcaaagatgcaggtggaagaggccagccgctccggtaaaatcgttttcgaaatggaagacgtttgctaccaggttaacggtaagcaactggtgaaagatttttctgcccaggttctacgtggcgacaaaattgccctgattggtccgaatgggtgcggcaaaaccacgctgctaaaactgatgctcggtcagcttcaagcggacagcgggcgtattcacgttggcaccaaactggaagtggcttatttcgatcagcaccgcgcggaactggatcccgataaaacggtgatggataaccttgccgaaggtaagcaagaggtgatggttaacggcaagccacgccacgtattgggctatttgcaggactttctgttccatccgaaacgggcgatgacgccggtacgtgcgctttctggcggtgagcggaaccgcttgctgctggcgcgtttgttcctcaaaccaagcaacttattgattcttgacgaaccgaccaacgatcttgatgtcgaaacgctggaactgctggaagaactgatcgacagctatcagggcacggtattgctggttagccacgatcgtcagtttgtcgataacaccgttacagaatgttggatcttcgaaggcggcggtaaaattggtcgttatgtcggcggttatcatgatgcccgtggtcagcaagagcagtatgtggcgctcaaacagcctgcggtgaaaaaaaccgaagaagccgccgcggcaaaagcagaaactgtaaaacgcagcagtagcaaactaagctataaattgcagcgcgaactggagcagctaccgcaattgctcgaagatctggaggcgaagctggaagccctacagacgcaagtggcggatgcttccttcttcagtcagccgcatgagcagacgcaaaaagtgcttgctgatatggctgctgcagagcaggagctggagcaagcctttgaacgctgggagtatcttgaagcgttaaaaaatggtggctgatcgcaaaatagtcgatttaaacagagacagctgacaacggtaaaattgcctgatgaactgggtttatcaggcatgaaaaccaacactttgttagtcatctgtaaaatagcgcatcattaaggagtaccaatgtgcgaacatcatcatgccgcgaagcacatcctgtgctcgcagtgtgacatgctggtggcgttaccgcgccttgagcatggtcagaaagcggcatgtccccggtgtggcacaacgttaaccgtggcgtgggatgcccctcggcagcgtcccaccgcctatgcgttggctgcactgttcatgctgttgctgtccaacttgtttccttttgtgaatatgaacgttgcaggagttaccagtgaaattacattactggaaattcccggcgtgcttttttctgaggactacgccagcctcggcacctttttcctgttgtttgtgcaactggttcccgcgttttgtctgataaccattctgttactggtgaatcgcgcggaattaccggtccgtttaaaagagcaactggcacgggtgctttttcaactcaaaacctggggaatggcggagattttcctcgcgggtgtgctggtcagtttcgttaaactgatggcttacggcagcattggggtaggcagcagctttctcccctggtgtttattttgtgtcctgcaactgcgcgcttttcagtgcgttgatcgtcgctggttatgggacgacatcgccccgatgccagaactgcgccagccgctaaaaccaggcgtcacggggatacgtcaggggctgcgttcgtgctcctgttgtacggcaatccttcctgctgatgaacccgtgtgcccgcgttgtagtaccaaagggtacgttcggcgtagaaacagcctgcagtggacactcgcgctgcttgtaacgtccatcatgctgtatcttccggctaatattttgcccatcatggtgacggatttattaggctcgaagatgccgtcgacgattctcgctggggtcattctgttatggagcgaaggctcttatcccgtcgctgcggtgatctttctggccagtattatggtgccaacgttaaagatgatcgccatcgcgtggctgtgttgggatgccaaagggcatggcaagcgcgacagtgaaagaatgcatttgatttatgaagttgttgagtttgtaggccgctggtcgatgattgacgttttcgttatcgcggtgctctcggcgctggtgcgtatgggaggtttaatgagtatttatccggcaatgggtgcattaatgtttgctttagtcgtcataatgacaatgttttctgctatgacgtttgacccgcgtttgtcgtgggatcgtcaacctgaatcagagcatgaggagtcctgacagtatggaatctaataatggggaagccaaaatccagaaagtgaagaactggtctcccgtgtggatatttcctatcgtcacggcgctcattggggcctgggttcttttttatcattacagccatcagggaccggaagtgaccctgatcaccgcgaatgcggaaggaattgaaggtggcaaaaccaccattaaaagccgtagcgttgacgtcggcgtggttgaaagcgccacactggctgatgatttgacgcacgttgaaatcaaagcgcggctgaattccggtatggaaaaattgctgcataaagacaccgtcttttgggtggtgaaaccgcagattggtcgcgaagggattagcggcctgggaacgctgctgtctggagtttatatcgaactgcagccaggcgcgaaaggcagcaaaatggataaatacgatttgctggactcgccaccgttggccccgcctgatgcgaaaggtatccgtgtgattctcgatagcaaaaaagccgggcagctctcgccaggagatccggtgctgttccgtggctatcgggtaggttcggttgaaaccagcaccttcgatacacaaaaacgcaatatcagctatcaactgttcatcaatgcaccttatgaccgactggtgaccaacaatgttcgcttctggaaagatagtggcattgcggttgatctgacgtcagcagggatgcgtgtggagatgggctcattgacaacgctgctgagtggcggtgtcagctttgatgtgccggaaggtctggatttagggcagccagtggcaccgaaaacagctttcgttttgtatgatgatcagaagagcattcaggattcgttgtacaccgatcacattgattatctgatgttctttaaagattcggtacgcggtctgcaaccgggagctccggtagagttccggggtattcgcctgggtaccgtaagcaaagtgccattctttgcgccgaatatgcgtcagacatttaacgatgattaccgtattccggtactgattcgtatcgagccagagcggctgaaaatgcagcttggcgaaaatgcggatgttgttgagcaccttggcgaattgttgaaacgtggtttacgcggatcgctgaaaaccggaaacctggtcactggtgcactgtatgttgatctcgatttctatccaaatacgcctgcaataaccggtattcgtgaatttaatggttatcagattatcccgaccgttagcggcggcctggcgcaaatccagcaacgactgatggaagcgttggataagatcaacaaactgccattgaatccgatgattgaacaggcaaccagtacgctttctgaaagtcagcgcacaatgaaaaacctgcaaacgacgctggatagcatgaacaagatcctcgctagccagtcgatgcagcagttgccgacggatatgcagtcaacgttgcgtgaattgaatcgcagcatgcagggcttccagcctggctccgcagcctacaacaagatggtggcggatatgcagcgccttgatcaggtgttgcgagaactgcaaccggtgctgaaaacgctcaatgagaagagtaacgcgctggtatttgaagcgaaggacaaaaaagatccagagccgaagagggcgaaacaatgaaaaagtggctagtgacgattgcagcactgtggctggccggatgcagctccggcgaaattaataaaaactattaccagttacctgtggtgcagagcggtacacaaagtaccgccagccagggcaatcgtctgttatgggtagagcaggtcactgttcctgactatctggcggggaatggtgtggtttatcaaaccagtgatgtgaagtatgtgattgccaacaacaacttgtgggccagcccgttggatcaacagttgcgcaacaccctggttgccaacctgagtacgcaactgcccggctgggtggttgcctcccagcctctgggaagcgcccaggacacgctcaatgttaccgtaacggagtttaacggtcgctatgatggcaaggtcattgtcagtggtgagtggctgttgaaccaccagggacaactgatcaaacgtccgttccgtctggaaggagtgcaaactcaggatggttacgatgagatggttaaagtgctggccggtgtctggagtcaggaagccgcttctattgcacaagagataaagcgtctaccttaattataaagatttgtaaatataaccgtctccggtatgttgcctgaggcggtttttttgtctctaacgtgcggaaaaatttgttcctcttcacattttttgtacaaccgacatgcccgtgtagctcacaaatatgacagtggcgtgaattttgcgcattgacggcagttatgattcgcggtattgcttaactgtgattgcacatttagtaatcactgttttcttttccaccagaaaccagtatgagggaaacgaggcatgaagagacaaaaacgagatcgcctggaacgggcacatcaacgtggttatcaggccggcatcgccggacgctcaaaagaaatgtgtccctatcagacgctgaatcaaaggtcacaatggctgggaggctggcgagaagccatggcggacagggtagtaatggcctgattctgtctctttaaaaagaaacctccgcattgcggaggtttcgccttttgatactctgtctgattataatcagaaggcagacgtatcctggaacagaccgactttcaggtcgctggcggtatagatcagacgaccatcaaccagcacttcgccatccgccaggcccataatcagacgacggttaacaatgcgtttaaagtgaatacggtaggtcacttttttcgctgtcggcagtacctgaccagtgaatttcacttcgccaacgcccagcgcgcggcctttaccttcgccgcccagccagccgaggtagaaccctaccagctgccacattgcgtccaggcccaggcatcccggcataaccggatcgccaataaagtggcatccgaagaaccacagatccggattgatatccagttctgcttcaacataccctttgtcgaagttaccacccgtttcggtcattttgaccacacggtccatcatcagcatgttcggtgctggcaattgcgggcctttagcgccaaacagttcaccgcgaccagaggcaagaaggtcttcttttgtataggattcgcgtttatctaccatgttctctgtaagccttattttattgaagcacgcaggatagctaacacgtgtacgctgaacaagtccgatcagttcggaataaaccagttcagccaacgtaatggccatggaaaacggtgacgtccttcctgttgcgatgcttgcgcgatacgttcctggatggtttgcatcagcgtcgtttggccttcgccatcccacaccagatttaataataacggcagtgcgtcagtcacatcgtctactgcccagatggtgaatttgccttcttctaccgctttcaccagttcactgtgaagacttaaatggcgaacgttagctgtggggataatgacaccttgtttcccggttaactcacgttgctggcaaatagcaaagaagccttcgattttctcatttaaaccaccgaccggctgggcgcgaccgaactgatcgactgaacctgtgatagcgatactctgattcaccggcacatcggcgagggcgcttatcagggcgcagagttcagccatcgaggcactatctccatcaacttcactgtatgactgctcaaatgtcagcgatgctgagaaggggatctgttgctcaagctgtagttccgacatcaggaacgcttgcatgatcatcatccctttcgcatggatattgccgccaagctccgctttgcgttcgatgtcggtgaattcaccatcgccaatatgcacaacgcagctaatgcgagaaggttcgccaaaagcgcgtggatgacccggaaattcaatgaccgaaagggcgttaatttgcccgatgcgttcgccttcggtttcaatcaggatttgctcctgaaggatctcatcctgcatacgttcagcgaggaaaccttcgcgccattcacgctgctgcagcattaagtttagctgctcgccggagaaggtgtcgccatcacacagggaggcgacctctttacactggcggaggatccactgcgggctaagcggaagtgtttcttgttcaccggtgtagcgtgctgcttcgcggataagtatcggccaggcatccgctcccggtgcaggtaagtgattatgtctggcggtaaatgtcacccagcgacaccactgggttactgactccgcatcgacaatctgcagagtatcttcaaattcgctataaatagcctgctctgaaagctctggctccatctcctggaaatcagccaatgattcgcgttcgcctaccagaatgactttcagcttcaatggcatcgaaggcacagagacggggagagggcgcgactcatcaaacgcaacccagtcaaaacgctcgcggttaacgatatttttcagccgcatccacagcagaggttgcgccagcagtgtacgcaaagagataatgagaataccgccatttgcctgatgcaccagaccaggctgcagggtaatgtcgccattaaactggcgcaggcagccaaagagttgctccgcttctacccagtcggcagcgacaacttgcgttaaagtcgcaaaattatcatctgcactcactgcgtgacgtaagcggatggagtggccggaaacctcatagtgaccgcccaccagttggcctgcatcgctttgtagcgtacgcgcggcattggcaataagattcagatactcagactcttccggggccttcgccagcataaaagaggaggatgctcgcgtatgcagcaactgctccagcgcaaattgcagccgcggttgagtatcactgaataaaggatcgttttcgtcaatcaaatgtggctgagcaaatatttcctgatagctatcggtatcaggaaccaggtcacgccatgcaagtttcgtaatggtcaaagttgatgttttttagtctgttgtcaaagccgcgattataccgtaaccggcactacagcacacgtagaaagcaccgacaatactcctggcatgggcgttaaagctcacaggatggagattcttttcttcactggcctaaaaagctgatattctgtaaagagttacacggtaacattgagatcgctatgaaatatcaacaacttgaaaatcttgaaagcggttggaaatggaagtatctggttaagaagcatcgcgaaggggagttaatcacccgttacatagaagccagtgccgcccaggaagccgtcgatgtgttgctctcgctggaaaatgaacccgtgctggtaaatggctggattgacaagcatatgaatccggaactggtcaatcgcatgaagcaaaccattcgggcaagacgaaagcgccattttaatgcggaacaccagcatacgcgcaaaaaatcgatcgatctggaatttattgtctggcaacgtctggctggtcttgcgcagcgtcgcggtaaaacgctttctgaaacgattgttcagctgattgaagatgcggaaaacaaagagaaatacgcgaataaaatgtcttctctgaagcaggatctgcaggcattgctgggtaaggaataactgacgaaagtcagttcaatttactaaaggcaaaaaaaaccccgcagcagcggggtttttctaccagacgagaacttaagcctgcggctgagttacaacgtctttgatacctttaacttcgatctctacgcgacgatccggagccaggcagtcgatcagtgcagcacgctgtttcacgttgtcacaggtgttgccagtaaccgggttggattcgcccataccacgtgcggagatcttgtctgccgggatacctttggagatcaggtaatcaacaacagactgagcacggcgctcggacagaccctggttgtaagcgtcagaaccgatgcggtcggtgtaacccagaacaactacggaaccgtctttcggatccaggttgctcagctggctgtacagctgatccagagcagcctgaccttccggtttcagggttgctttgttgaagttgaacagaacgtcagacttcagagtgaagtgcttggtctgtacttccggtgccggagctggagccggagcaactactggagctgcttcgccctgaccgaaacggtaggaaacacccaggctcagcatgccgttgtccggacgagtgccgatggtgtgtgcgtcaccgatgttgttggtccactggtattccagacgggtagcgatttcaggagtgatcgcgtactcaacaccgccagcgaagaccggagaaacgccggtgtcgtggtttttaccataaacgttggatttagtgtctgcacgccataccatgccacccagacgagtgtagatgtccaggtcgtcagtgattgggtaacccagtttagcggtcagttgaacgccctgagctttgtatgcaccgttttcaacgctgcctttgtacggcatacgacctaaccagtcgtaacccatttcaaagccaacatacgggttaacctggtaaccaccaaaagcaccagcgcccagttggttttcatgggtcgggccattgttgttgatgaaaccagtgtcatggtactgggaccagcccagtttagcaccagtgtaccaggtgttatctttcggagcggcctgcgctacggtagcgaaaccagccagtgccactgcaatcgcgatagctgtctttttcattttttgcgcctcgttatcatccaaaatacgccatgaatatctccaacgagataacacggttaaatccttcaccgggggatctgctcaatattaactctaccgatatcttcggcttatgccgagcacccctggcgatgtaaagtctacaacgtagttgaaaacttacaagtgtgaactccgtcaggcatatgaaaaaaaagtcttgtataaggtatgtttaatcttttttgtcagcgacaatttacagaagagaatcgcggaaaccgcttcagacaagcctccgcaaggaaaattagtcacgactgaaagcattggctgggcgacaaaaaaagttccaggattaatcctaaatttacttaatgatacaaattagagtgaatttttagcccggaaagttgtctcgtggcgtgagaggatgcgcttaccggacgcataataaaccccatagcgttaccttcatttgccgcatcaacaagttcagcatgctcttcttcagtcaaatcatctgccaaccaaccgatcaccacactgtaattgcccgtgcgtaaagcgcgaaccattgactccacagtgtggcaaggggagagctggctaatctgcattactttcgttaagggtagcccagatgcctgaacccattcccgactcagtttttgttgcggtgttaaccagagttgccagcgcgattgctgaccgagttgctgtaacaatggcaacagtagaagttgcgtcatcatgggctgatcttcgcgatagacaacttcactgataagcccggctgtagtgttttccgtagagacacgcgcaattttacttgctgcggatgagaacgacgaagaacgatgtgcatagcctgaagtgtacataatcaatccagcccctgtgagttactgtatggatgtacagtacatccagtgacaacaaagatcaaccctattttcggaaagagcctcgcaaattttgtcgttggtgacgggaaaacataaattaatcttgccccttaagaataagttgcctattttcgtagttaacggatccgttaatgtgaatcattcttttatgttatgattttaaaaggaattttatgaaaagcctctcctataagcggatctataaatcacaagaatacctggcaacgttgggcacaattgaataccgatcattgtttggcagttacagcctgaccgttgacgacacggtgtttgcgatggtttctgatggtgagttgtatcttcgggcttgtgagcaaagtgcacagtactgtgtaaaacatccgcctgtctggctgacatataaaaagtgtggccgatccgttaccctcaattactatcgggttgatgaaagtctatggcgaaatcaactgaagctggtgcgtctgtcgaaatattctctcgatgcagcgctgaaagagaaaagcacgcgcaatacccgggaaagactgaaagatttgcccaatatgtcttttcatctggaagcgattctcggggaggtggggattaaggatgtacgggcgttacgtatacttggggcaaaaatgtgttggttgcgactgcggcagcaaaacagtctggtgacagaaaagattctgtttatgcttgaaggtgccattatcggcattcatgaagctgcgctcccggtggcacgccgccaggagcttgcagaatgggctgactctcttacgccgaaacaggagtttcctgcggaacttgagtaatctggcgttgcagacgaccaatctcaggcagtaatgcaatcaataatccaacttgttgtacgaccagaggttctttgctgtctgcccgtggttcaagttgctgcatccgctgtttcaggctagctaatgcctcattgacgcgttcttcatcagcaggttgatgatgtaacgcgtcatcaacatagcaaactgcgtcatcaagaaacgccagaatttcaggattagttaactgctcccggtgagcaccgagggctgagatatagctggtaaacgtatggttaaggcacagcaaccgaaacgcggcttcgcgaatttgcggggtaacgttcggctcgctggacatatttgataccaccgacgccagctcagcatcacggttgtgtgcatcgcggcgggcaatacgatacgccagacggttatcacgcccctgatggtattgctccagtatggcatcgagataccgacagttggcctctgtggcgcgttcgagcatgcgcggcagattgcgaaactgccagtcaggccagatgtagctcactgccgcccacgcaatggcacaaccaatcagcgtatcgattacgcgaggtaacgctacttcaaaaccttcacccagtaagttaaaacacagtagcaccaaaagtgtgatgaacatcgttgcatgagcgtattgcacgttacggaaggcaaaaaagagcacgccggtaataaccagcagcaccagctgcccttccagtgatggcacaaaccacagcacaggaatgccaatggcgatacctaccagcgtaccaataatccttaacttcaggcggtggcgcgtggcgttatagtttggctggcagacaaacaaacttgtcagcaagatccaatacccgtgatgcattccggttatctgaatgatggcgtagccgaagcacaacaccagcgacattcttaccgcatgacggaagagggcggattccggcgtgaagtgacggctaagacgcagccagatatcactcaacccgtgcgggctgtcatcagcgagctcattttcgtcattattatggggtagtgcctgggcctgttctgattcaattgttgccagttgggcatcaatggcgcgtaaattgttcagcaaaaatcccagtgttttgagtaaatcggcgggtgcgccgttatcgcgcatccgctccagcgcagcatcaatatgcgtaaaagcgcgctcaaaatgcggatcatgttgataaggctgacgcaacaaaatacagcgtgacagttgctggcacgcctggccctgcatcgacatcagccgctgaaaacggaacagcacgtcgctgtggcgaaaatgttcacgcaatgtttgatactgaatatgagaagagctggcacgctcgtgaatatcctgtgcgacaaagtaataatgcagcgtgcgacgcgttccccgttgaccacgatcgccacgtaagcgggtcagcagcgagagtttcgtctgattcaatgtcgccatcagcagaccgttggcgagagccaaatcgtacagcggtgcctggctttgatcttcaatatcaggatcaaacatgcgcgacttgagctcaagataacgcgccagttgttcatagcaacgcgccaggttgtcctgcagcgggcggaccgggaacagcagatgaccaataagtgtcaggacgttgtaccagacggcaccggccagcagatacatcggctgctgataccagtgctcatacagtgatgttcccaacatagtgtaaatggcgatcagcaatgcaccgaaggcaattgttgcatagcgttgacccagaccgccgagcaaaatgaagccgctggtagagagcgttaagccaatcgcaaatagccagggccagggaaacagcaattctactgaggccgaggcgataaaaaagcagaacagcgtaatgatgaggttacgcaaacgtcccgccagtcggtcatcgagatcggtcagcgccgctgccaccatccccagcgttagcggaatcgtcagttttacatcacccagccaccacggaaacgctgtggttccacaaagcgcaataaaaatacgcgcgtaatacagccaggcgctgttccaggtatagcgtttgagcaaaggacttagcataaaggccatattagtggattattcaaaacgacgacgtgcattggcttcacgcgcagcttgcgctgtttctaccgataccacgcgacgaccaaccggccatagtgcaatagcggcaattttaaagttcgcaatgccgacaggaatgccaatgattgaaatacattgtgcgatgcccgttgcaatgtgcatcaggcataaccaccagccaaagaaaatcagccagaaaatattcaataccgtaccgccagtattcagcagcacatttttgccagccgggttcagttcatcgacatgaatagcttcattgccataaggcaccagagacagtttagtgatctcccagcaggatcgtgtcagcggtaaggtaaaaatcagcacaatactgaccagagtcgccaacagccagcccagagtggtggcaaatccgccaagcacaaagttcagaatgttcaaaacggtacgcataaaacctcgctttactgtggttttcagtaatgggcggcaattgtaacgtttttttgggctggagcacgttttctctgacggttacactgataagaaataatttcgtgtggatctacagagtcatggaactgaaagcgacaacgcttggaaaacgtctggcacagcacccttacgatcgggcggtgatcctcaatgccgggattaaagtctccggcgatcgccacgaataccttattcctttcaatcaattactggcgattcactgtaagcgcggtctggtatggggcgagctggaatttgtactgccggacgaaaaagtggtgcgtctgcacggcaccgaatggggcgagacgcagcgtttttaccatcatcttgatgctcactggcggcggtggagtggcgagatgagcgaaattgcgtctggtgttttacgccagcaactggatttgattgccacgcgcactggggaaaataaatggctgacgcgtgagcaaacctctggcgtgcagcaacaaatccgccaggctttgtcggcgttgccgttgccggttaaccgactggaagaattcgataactgccgtgaggcgtggcgtaaatgtcaggcctggttgaaagatattgaaagcgctcggttgcagcataaccaggcgtataccgaagccatgcttaccgagtatgcggattttttccgccaggtcgagtcttcaccgctgaatccggcgcaggcccgggcagtcgttaatggcgagcattctctgttagtgctggcaggtgcaggaagcggaaaaacgtcggtgctggtggcccgtgcaggctggttgctggcgcgtggtgaagcgtcccctgagcaaattttattgctggcgtttggtcgcaaagccgctgaagagatggacgagcggattcgcgaacggctacataccgaagacattaccgcacgcacgtttcatgcgctggcgctgcatattattcagcagggcagcaaaaaagttccgatagtcagcaaactggaaaatgataccgctgcccgtcatgaactctttattgctgagtggcgcaagcaatgcagcgaaaagaaagcgcaggcgaagggctggcggcaatggctgacggaagaaatgcagtggtcagtgccagaaggtaacttctgggatgatgaaaaattacagcgtcgccttgcctctcgcctcgatcgctgggtaagtctgatgcggatgcacggtggtgcacaggcagaaatgattgccagtgcacccgaagagattcgcgatctgttcagtaaacgtatcaagttgatggccccgttattaaaagcctggaaaggtgcgctgaaggcagaaaacgctgtcgatttttcgggccttattcatcaggcgattgtgattctggagaaaggtcgctttatcagcccgtggaagcatattctggttgatgaatttcaggatatctcgccgcagcgggcagcgttgttagcggcattacgcaagcaaaacagtcagacgacgttgttcgctgttggtgatgactggcaggcgatttaccgattcagcggtgcgcaaatgtcgctcaccaccgctttccatgaaaactttggtgaaggcgaacgctgtgatttagacacgacttaccgttttaacagtcgtatcggtgaggtggcaaaccggtttattcagcagaacccaggccagctgaaaaagccgctaaacagcttaaccaatggagacaaaaaagccgtcacgttattggatgagagtcaacttgacgctttgctggataagctctctggttatgccaaaccggaagagcgcattctgatcctggcgcgttaccatcacatgaggcctgccagcctggaaaaagcggcaacacgctggccgaagttgcaaatcgactttatgaccattcatgccagcaaagggcaacaggcggattacgtcatcatcgttggcttgcaggagggaagtgatggttttccggctgcggcgcgggagtcgattatggaagaggcgctactgccaccggttgaggatttcccggacgctgaagaacggcggttaatgtacgtggcgctgacccgggcacgccatcgggtatgggcactgtttaacaaagagaatccctctccctttgtggaaatactgaaaaatctggatgtgccggtggcgagaaaaccgtaagaaacaggtggcgtttgccacctgtgcaatattacttcagacggtccgcgagataacgctgataatcggggatcagaatatcgaccgcgtcgttgaaatgcggcgactggattatgaagtctgccgttgccacgttggtggcgaccggaatgttccataccgtcgccagacgcagcaaggctttcacgtcaggatcgtgcggcacggcatttagtggatcccagaagaaaatcaatacatcaattttcccttctgagatcaatgcgccaacctgctggtcaccccccattgggccactcaacatcgcgttgacgttcatgccggtcgcgcgggaaattaagttaccggtagtgcctgttgcatacagtacgtgttgttccagtaacggttgatgccgttccacccagctcatcagcatttgtttgcagtgatcgtgtgccaccagcgcaatatgtttccgcgcaggtaaagtgcgagtcgtcagttccataatgtacatccgtagttaactttcctacagattactgtaagcacttatcgctgcaagataaagaccgaaaaagcctgcgcacaggcacaaaaatctcaggaagatggttgtttttccgcccactgcaggaaagtatttcgcgtttgtgggtcagccagtttaaaccaatacttcagccgttgttctgtgagcacctgagactgcggtggaatagcatccagctcggaaacacccgaaagcagcgtactgtcatctgccatcatcgtggcaaattgcggtagtgaagcgcgtttcgcggatttgttatagcgttcaacctcgacctcataatcaatcgtttttgccgttgaggtaatggcgagaatatccagctttaccggaatcggcgtcgcatcgccatccaacaattcaaggcgcggcgcggcatcaaaatggttagcttcccgctcattctccaggcgaggcaggcgaaaattgacctggttgatgagctgggtattaaaactgaccaccagcggtggggagatatacagccgttcttcactattggaaagatgaatcgtcttctcaacgcgaaacactaactgatgcggtccattatccagttcaatgctgtccgcaccgcgcagcagagagctggaaaccttcttgccgtcgagtaccagaagatcgacatcggttgaaagccgcagcgtggtggcaaaaacggataccggcaaacataatgcaatcaaggtggtcacgatgccggttttcataggtagctcctgtcaaaagaccgcccgaataataatgtgtcaaaatttttctttaatcatacttactaacatatagacatatttcccgcttttgctctcattcattcgtattagctgcatggttggcatgtcggctttgtcgtacactttgttaaacagtctggaggaaataatgaaagaaaccgatattgcaggcattttaacgtccactcacaccattgcgctggtgggggcaagcgacaaacccgatcgtcccagctatcgcgtgatgaaatatctactcgaccaggggtatcacgtcattccggtttcgccaaaagttgccggcaaaacgctgctgggccagaaggggtatggcacgctggcagacgttccggaaaaagtcgatatggtcgatgttttccgtaattcagaagcggcgtggggcgtggcacaggaagctattgccattggcgcgaaaactctctggatgcaactgggggtgattaatgagcaagcggcagtactggcacgggatgccgggttaaatgtggtgatggatcgctgcccggctattgagatccctcgcctgggcctggccaaataaaaaatccccggaaggcaaaaaccttccggggatttgttcagggattagttacgcagacgcggggcctggagttgtttgcggatggtctgcgccagctcatccatggatggctgttcaggatgttcatcctgcaattcgctacttagctgggcttcagccaggtaggtatgaaccggtaggccgttatcgtcctccatcactacgtgataccacggagcggcgcgaagctcgtcattcaccgccagctcatcaggcgacggttcagagagcgaataaaccgggtcgatatccacgaccactccgagataacctaacagggaatggcggacctgctggccgataccgaatttgctggcaatcatagtcacctcccgggaaatctttacctttgatataagggtaaaattccacatttcaagttacatgacgcgacaggcaaaccctttcagatatagcccttccggataggtagcgatcaccggatgatcggctgcctgacggaactgctctataaattgtacatcacgaccggcatcaattgcggcatccgcgatgattttctgaaataaatcgctggtcatcagaccggaacaggagaaagtcaggagaataccgccttcattcagcagctgaatcgccagcatgttgatgtctttataaccacgacacgcgcccatcaactggcttttattctcaacaaacttcggcgggtccatcacgataacgtcaaatttttcaccgcgatcgcgataagtacgcagcaatttaaagacatcatcacggacaaactcagccttgctcagatccagtttgttcagctcaacgttctgccgtgcaatatccagcgcttcctgggaggtatcaacgctgacaacctggctgcaaccgcccatcagtgccgatacggcgaaaccaccggtataggagaaacagttcagcacacgtttattttcaacgtagcggcgggtagccaggcggctatcacgctggtccaggtagtagcccgttttgtgtccgtgctgaatatccaccagcagtttcattccgtgttcttcaatcggcagcagggcaggtggcaactcgccggtgacggggccctgggtcagctccattccttcttttttacgtaccgcgacgtcgctgcgatcgtaaatcgaacattccgggtacagcgtttgcagggcactaattaatgccgcgcgctgatattctgccccagcactcagcagttgcagcaccagaaaattaccgaaacgatcgatagtaatacccggcaggccatcagattctccggcgattaaacgatagctgtcgaggccatctttttgcgccagccagtcacgccatttttgtgcttgttgcaaacggcgggaaaaaaaagcaatgtcgatagactcagacgggtcaaacgtccagacgcgcgcccggatttgcgaagctggcgaataagcgccgcgtgctaaccattttccctgatgatcaacaatatcgatggtttcaccgaggctggctttaccttccatgcgggcaacggccccggaaaagacccacggatggcgacgaagtaatgatttttcgcgccctttggctaacactaaacgtacactcataatttacttttctgtcgatgcaaagaaatgggcgtcattgtccggagttttccatggatttgcaacgcgtccattaaggataaggagagcagcaatgtcgaaagtctgcataattgcctgggtttacgggcgagttcagggcgtaggatttcgctacaccacacagtacgaagcgaaaagactgggtttaaccgggtacgccaaaaatcttgacgatggcagcgtggaagtggttgcttgcggtgaagaagggcaggtggaaaaattaatgcagtggttaaagagtggcggcccgcgttctgcgcgtgtagaacgggtgctcagcgagccgcatcatccctcgggggaattaaccgattttcgtatccgttaaatacattttaccggttttggcaggccagcaattttggtggcttgcttagccggacctttcggaaacagtcggtataaatagcggctgttacctttttcttcgccaaatttattcgccatcgcttttaccagcatacgaatcgccggagaagtattgaattccagatagaaatcacgcacaaaacgcaccacttcccagtgttccggtgacagcgaaatcccttcgttctctgcaatcaccacagccagcggctcactccactggctgctttctttgagatagccttcggtatccgtttctatctctttaccttcgaagatcagcataattattactaccttaatcagactggcggcagtgtaacaaaaaacaaagccccgcataaagcgaggctatgaaagtgttagcgggtgagattaatcgcggctagcgaagcccagaatgctcagcaggctgacgaagatgttgtacagcgaaacatacaggctaaccgtggcacgaatatagttcgtctcaccgccatgaatgatgttgctggtttcaaacaagatagcgccagaggagatcagaatgaagaccgcgctgatcgccagatgcagagcaggcagctgcaggaagatattcgcaaccataccaatcagcaccaccacaatacccgccatcagcataccgccgaggaacgacatatctttgcgggtggtcagcacatatgcagagcagcagaagaacactaacgccgttccgcccagtgccatagcgattacgtcacccattccggcagacagataggtgttcagaataggtccgaggatataacccagaaaaccggtaaaggcgaatgcggagataatcccggtcggcttattcgccgttttataggtcaggaacatcaaaccatacatacccaccagcgtcagaatcagacccggagatggcagcatcagcaccgtactggcagttgcggtaatcgccgaaaaggccagcgtcaggctcagcagaaaataggtattacgcagcaccttatgggtgctaagcagtgatgtacggtcatgtgaagaactaacaatacgatccattgagtcactctctatgacagatgtaattaattaagcagcataatgataatgcgtaagggcacccagaagttttacccatctttacgcatttgatctggaacaggtttaacagcggattatcaggtcattaagcaaatataacgccctgagaatttcgacaggcaaaagaaaaaggggttagcatttagctaaccccttatcttatttggcggaagcgcagagattcgaactctggaaccctttcgggtcgccggttttcaagaccggtgccttcaaccgctcggccacacttccggaatgacgcgcactataaacatcccgatgcggcgtgtaaacccctaatttgtttgtttgcctgaaaaacagccaaaagtgcattgatagcgtgaaataacagcagattgatcatttcatcaccatgaattccttctcttttactcgtttagcaaccggctaaacatccccaccgcccggccaaaagaaaaataggtccatttttatcgctaaaagataaatccacacagtttgtattgttttgtgcaaaagtttcactacgctttattaacaatactttctggcgacgtgcgccagtgcagaaggatgagctttcgttttcagcatctcacgtgaagcgatggtttgccttgctacagggacgtcgcttgccgaccataagcgcccggtgtcctgccggtgtcgcaaggaggagagacgtgcgatatgaataacgaggaaacattttaccaggccatgcggcgtcagggcgttacccggcgcagctttctcaaatattgtagtctggctgccacgtcgctgggattaggcgcgggaatggcaccaaagattgcctgggcgctggagaacaaaccgcgcattccggtggtatggatccacggtctggaatgcacctgctgtaccgaatcttttatccgctccgctcacccactggcgaaggacgtcatcctttccctgatttccctcgattacgacgatactttgatggctgccgccggaacccaggcggaagaagtctttgaagacatcatcacgcaatacaatggcaaatatatcctcgcagtagaaggtaatccgccgctgggcgagcaggggatgttctgtatcagcagcggtcgaccgtttattgagaaactcaaacgtgccgctgccggagccagcgcgattatcgcctggggaacctgcgcgtcctggggctgcgtgcaggccgcgcgacccaatccgacgcaggcaacgcctatcgacaaagtcatcaccgacaaacccattatcaaagtacctggctgcccgccgatcccggatgtgatgagcgccatcattacttacatggtgacctttgatcgcttgccagatgtcgacagaatgggccgtccgctgatgttctatggtcagcgaatccacgataaatgctatcgccgcgcccacttcgacgccggagagttcgtccagagttgggatgatgacgctgcccgcaaaggttactgcctgtacaaaatgggctgcaaagggcctaccacctataacgcctgttcctccacacgctggaatgatggcgtttctttcccaatccagtctggtcacggctgcctgggctgtgcggaaaatggtttctgggatcgcggttcgttctacagccgcgtggtcgatattccgcaaatgggtactcattccaccgccgataccgtcggtttaaccgcgcttggcgtggtggcagcggctgttggtgtgcacgcagtcgccagcgccgttgaccagcgcagacgtcataaccagcaacctacagaaaccgaacatcagccaggcaatgaggataaacaggcatgagcactcagtacgaaactcagggatacaccatcaataatgccggacgccgcctggtggtcgacccgattacgcgcatcgaaggccacatgcgctgcgaagtgaatattaacgatcagaatgtgatcaccaatgccgtctcctgcggcaccatgtttcgcgggctggagatcatcctacaagggcgcgacccgcgcgatgcgtgggcgttcgttgaacgtatctgcggcgtctgtactggcgtacacgccctggcttcggtttacgccatcgaagatgctatcggtattaaagtgccggacaacgccaatatcatccgcaacattatgctggcaacgctctggtgccacgatcatctggtgcacttctatcagcttgccgggatggactggatcgatgtgttagatgcgctgaaagccgacccgcggaaaacctccgaactggcgcaaagtctctcctcttggccgaaatcatcccctggctatttcttcgacgtacaaaaccgcctgaaaaaatttgttgaaggcgggcagttggggatcttccgcaatggctactgggggcacccgcagtacaaactgccgccagaagctaacctgatgggctttgcccactatctcgaagctctcgatttccagcgtgaaattgtcaaaatccacgcggtctttggcggtaaaaacccgcatccaaactggattgtcggcgggatgccttgcgccatcaacattgacgaaagcggcgcggtcggggcagtcaatatggaacgcctgaacctggtgcagtcaattatcacccgcacggcggacttcattaacaacgtgatgatccccgacgccttagccatcggtcagttcaacaaaccgtggagcgaaatcggcactggtctttctgataaatgcgttctcagctacggcgcattcccggatattgccaacgactttggcgagaaaagtctgctgatgcctggcggcgcggtgattaacggcgacttcaacaatgtgctgccagtggatttggttgatccgcagcaggtgcaggagtttgtcgaccacgcctggtatcgatatcccaacgatcaggtcgggcgtcatccgttcgatggcatcaccgacccgtggtacaaccccggcgatgtcaaaggcagcgataccaacattcagcagctgaatgaacaggaacgctactcgtggatcaaagcgccacgctggcgcggtaacgcgatggaagtggggccgctggcgcgcacgttaatcgcttatcacaaaggcgatgctgcgaccgttgagtcggtcgatcgcatgatgtcggcgttgaacctgccgctttccggtatccagtcaacgttaggccgcattttgtgccgcgcgcacgaagcgcagtgggccgcaggtaagttgcagtatttcttcgacaagctgatgaccaacctgaaaaacggcaatctcgccactgcttccacggaaaaatgggaacctgcaacctggccgacagagtgccgtggtgtcggttttaccgaagcgccgcgcggggcgttaggccactgggccgccattcgcgatggcaagattgatctctaccagtgcgtggtgccgaccacctggaacgccagcccgcgcgatcccaaagggcagattggcgcttatgaagcggcgctgatgaacaccaaaatggcgatccccgagcaaccgctggagatcctgcgtactctgcacagctttgacccgtgcctcgcctgttcaacacacgtgctgggcgacgacggtagcgagctgatctccgtgcaggtgcgttaacagcgaaggagaatcatcatgcaacagaaaagcgacaacgttgtcagccactatgtctttgaagcgccagtgcgcatctggcactggttgacggtgttatgcatggcggtgttgatggtcaccggatactttatcggcaagccgctaccttccgtcagcggcgaggcgacgtatctgttctatatgggctacatcaggttaattcacttcagcgccgggatggtttttaccgtggttttgctgatgcggatctactgggcttttgttggcaatcgatactcccgcgagctgtttatcgtgccggtatggcgtaaaagctggtggcagggcgtgtggtatgaaatccgctggtatctgtttctggcaaaacgtccgagtgccgatataggccataatcccatcgcccaggcggcgatgttcggctatttcctgatgtcggtctttatgatcatcactggttttgcgctgtacagcgaacacagccagtacgctatttttgcgccgttccgttatgtggtggaatttttctactggacgggtggcaactcaatggacattcacagctggcatcggctggggatgtggctgattggcgcgtttgtgatcggtcatgtctacatggcgctgcgtgaagacatcatgtccgacgacacggtgatctccaccatggtcaacggctaccgtagccacaaatttggcaaaataagtaacaaggagcgttcatgagcgagcaacgcgtggtggtcatggggctgggcaacctgctgtgggccgatgaaggcttcggcgtgcgggtggcggaacggctgtatgcccattaccactggcccgagtatgtggagattgtcgatggcggtactcagggactgaacttgctggggtatgtcgaaagcgccagccatctgttgattctcgatgccattgactacgggctggaacctggaacgctgcgaacctatgccggagaacgcattccggcttatctcagcgcgaagaaaatgagcctgcatcagaacagtttctccgaagtgttggcgctggcggatatccgcggacatctgccagcacatattgccctcgtcggtctgcaacccgcaatgctcgacgactacggcggtagcctgagcgaactggcacgggagcaactgcccgctgcggaacaggcggcgctggcgcagcttgctgcgtggggaattgtgccgcaaccggctaatgaatcgcgctgtctcaattatgactgtctgtcgatggaaaattacgaaggcgttcgcttgcgccagtaccggatgacacaggaggagcagggatgagcaacgacacgccatttgatgcgttgtggcaacgaatgctggcgcgcggctggacgccagtcagtgaatcccgtcttgacgactggcttacgcaagcgccagacggcgtggtgttattaagcagtgacccgaaacgcacgccagaggtcagcgataatccggtaatgattggcgaattactgcgcgagtttcccgactatacatggcaggtggcgattgctgaccttgagcagagcgaagccatcggcgatcgctttggcgtctttcgctttcctgccactttagtgtttaccggcggaaactatcgcggcgtgctgaatggtattcacccgtgggcggaactgataaacctgatgcgcgggcttgtcgaaccgcagcaggagcgtgcctcatgagcgaaacttttttccatctgctggggccaggaacgcaaccgaacgatgacagtttcagcatgaatccactgccgatcacctgtcaggtgaatgatgaaccgagtatggcggccctggagcaatgtgctcacagcccgcaggtgattgcgctgttaaacgagttacaacatcaactaagcgaacgccaaccgccgttgggcgaggtgctggcagtcgatctgttaaatctcaacgccgacgatcgtcactttatcaatacgcttctcggggaaggggaagtgtcagtgcgcattcagcaggctgacgacagtgaaagtgaaatacaggaggcgatcttctgcggattatggcgggtgcgcagacgtcgcggcgaaaagttgctggaggacaaactggaggctggctgcgcgccgctggcgttgtggcaggcggcaacgcaaaatctcttgccgacagattcgctgttaccgccgcccattgatggcctgatgaatggcctaccgttggcgcatgagttactggcacatgtacgtaaccccgacgcgcagccgcacagcattaatctgacgcaattacccatcagcgaggctgatcggctttttctctcacgtctctgtgggccgggaaatattcagattcgtaccattggctatggcgagagctatatcaacgccacggggttacgccatgtctggcatttacgctgtacggacaccttaaaaggcccgttactggaaagttatgaaatctgcccaataccggaagtggtgctggcagcgccagaagatttggtcgactctgcgcagcggcttagcgaggtatgtcagtggctggcggaagctgcaccgacgtaaaaagacggtaagtatcgctttcagtcttatgaatatcgcaatcggcgaatacctctggtcgtagagtttcaggataaagagggagatctaccattatcgggttatttttctctcttcgcctacaggagtgcgcatgtgggatgtcattgatttatcgcgctggcagtttgctctgaccgcgctgtatcactttttatttgtaccccttaccctggggctgatttttttgctggctattatggaaaccatttacgtggtcaccggcaaaacaatctaccgcgatatgacgcgcttctggggtaagctcttcggtatcaattttgctcttggcgtggctaccggcctgaccatggagtttcagtttggtactaactggtcattctattccaactatgtgggcgatatttttggcgcaccgctggcgatggaagcattaatggccttcttcctcgaatccacctttgtcgggctgttcttcttcggctggcaacggctgaataaataccagcacctgctggtgacgtggctggtggcgttcggttcaaatctctctgcgttgtggatattgaatgccaacggttggatgcaatacccgaccggtgcgcattttgatatcgacaccctgcgtatggagatgaccagcttcagcgagctggtctttaatccggtcagccaggtgaaatttgtgcacaccgtaatggcgggctacgtgaccggggccatgtttattatggcgatcagcgcctggtatttactgcgcggacgggagcgcaatgtcgcattacgctcgtttgccatcggttccgtcttcggtactctggcgattatcggtaccctgcaactcggagacagttctgcgtatgaagtcgcgcaagtacaaccggtaaaactggcggcgatggaaggggagtggcaaacggaacctgcacctgcaccgttccatgtggttgcctggccggaacaggatcaagagcgtaacgcctttgccctcaaaattcccgcgctgctagggatcctcgccactcactcattagataaacccgtgccgggtctgaagaatttgatggctgaaacctacccacgcttgcaacgcggacgtatggcctggctgttaatgcaggaaatatcgcaaggcaatcgtgagccgcatgtgttgcaggcattccggggactggaaggtgacctgggctacggcatgttgctctcccgctatgcgccggatatgaatcatgtcacagccgcacagtaccaggcggcgatgcgtggcgcgatacctcaggttgcgccggtattctggagtttccgcatcatggtgggctgtggttccctgctgctactggtgatgctgattgcgcttgtccagacgctgcgtggcaaaatcgaccagcatcgctgggtgctgaaaatggcgctctggagtttgccgttgccgtggattgcgattgaagccgggtggtttatgaccgagtttggtcgtcagccgtgggcgatacaggacatcttaccgacatactccgcgcactccgctttaaccacaggacaactggctttctcactgatcatgatcgtagggctttacaccctgttcttaatcgccgaagtctacctgatgcagaaatatgcccgtctggggccgagcgcgatgcagagtgaacaaccgacgcagcaacaggggtaaaggagaaaatcatgtttgattatgaaacattgcgcttcatctggtggctgctgattggcgtgatcctggtggtctttatgatctccgacggatttgacatggggatcggctgtctgctgccgctggtggcgcgtaatgatgatgaacgccggatagtgataaacagcgttggtgcacactgggaaggcaaccaggtctggttgatcctcgctggtggggcattatttgccgcctggcccagagtgtatgcagcggcgttttccggcttttatgtggcgatgatcctggtgctgtgctcactgttcttccgcccgctggcctttgattatcgcggaaaaatcgccgatgcacgctggcgtaaaatgtgggacgccggtctggtcatcggcagtctggtgccgccggtagtcttcggtatcgccttcggcaacttgttgctcggcgtgccgtttgccttcacaccgcaattacgcgtggagtatctcggcagcttctggcaactgctgacgccattccctttattgtgcggattgctcagccttgggatggtgattttgcaaggtggcgtctggttacaactgaaaactgttggtgtgattcatctgcgttcacagctggcgaccaaacgcgctgcactgttggtgatgctgtgctttttgctggcgggttactggctgtgggtcggtattgatggctttgtactgctcgcccaggatgctaacggtccttccaatccgttaatgaaactggtggcagtgctacctggtgcctggatgaataattttgtcgagtcgcccgttttgtggatcttcccgctgctgggattcttctgcccattgctgacggtgatggcgatttatcgtggtcgcccgggttggggatttttgatggcatcattgatgcaatttggcgtgattttcacggcaggcatcacgctgttcccctttgtcatgccgtcaagcgtgagtccgatctccagcctgacgttgtgggacagtacttccagtcagctgacgctgagcattatgttggtaatcgtgctgatatttttgcccattgtgttgctctacactctctggagctactacaaaatgtgggggcgcatgacaacagaaactctccgccgtaacgaaaacgagttgtactaaggagcagaaacaatgtggtatttactttggttcgtcggcattttgttgatgtgttcgctctccacccttgtgttggtatggctggacccgcgtctgaaaagttaacgaacgtaggcctgatgcggcgcattagcatcgcatcaggcaatcaataatgtcagatatgaaaagcggaaacatatcgatgaaagcgatcttaatcccatttttatctcttctgattccgttaaccccgcaatctgcattcgctcagagtgagccggagctgaagctggaaagtgtggtgattgtcagtcgtcatggtgtgcgtgctccaaccaaggccacgcaactgatgcaggatgtcaccccagacgcatggccaacctggccggtaaaactgggttggctgacaccgcgcggtggtgagctaatcgcctatctcggacattaccaacgccagcgtctggtagccgacggattgctggcgaaaaagggctgcccgcagtctggtcaggtcgcgattattgctgatgtcgacgagcgtacccgtaaaacaggcgaagccttcgccgccgggctggcacctgactgtgcaataaccgtacatacccaggcagatacgtccagtcccgatccgttatttaatcctctaaaaactggcgtttgccaactggataacgcgaacgtgactgacgcgatcctcagcagggcaggagggtcaattgctgactttaccgggcatcggcaaacggcgtttcgcgaactggaacgggtgcttaattttccgcaatcaaacttgtgccttaaacgtgagaaacaggacgaaagctgttcattaacgcaggcattaccatcggaactcaaggtgagcgccgacaatgtctcattaaccggtgcggtaagcctcgcatcaatgctgacggagatatttctcctgcaacaagcacagggaatgccggagccggggtggggaaggatcaccgattcacaccagtggaacaccttgctaagtttgcataacgcgcaattttatttgctacaacgcacgccagaggttgcccgcagccgcgccaccccgttattagatttgatcaagacagcgttgacgccccatccaccgcaaaaacaggcgtatggtgtgacattacccacttcagtgctgtttatcgccggacacgatactaatctggcaaatctcggcggcgcactggagctcaactggacgcttcccggtcagccggataacacgccgccaggtggtgaactggtgtttgaacgctggcgtcggctaagcgataacagccagtggattcaggtttcgctggtcttccagactttacagcagatgcgtgataaaacgccgctgtcattaaatacgccgcccggagaggtgaaactgaccctggcaggatgtgaagagcgaaatgcgcagggcatgtgttcgttggcaggttttacgcaaatcgtgaatgaagcacgcataccggcgtgcagtttgtaatgcataaaaaagagcattcagttacctgaatgctctgaggctgatgacaaacgaagaactgtctaatgcgtagaccggaaaaggcgttcacgccgcatccggccactttcagttttactctttctcggagtaactataaccgtaatagttatagccgtaactgtaagcggtgctggcgcgtttaatcacaccattgaggatagcgcctttaatattgacgcctgcctgttccagacgctgcattgacaaactcacctctttggcggtgttcaagccaaaacgcgcaaccagcaggctggtgccaacagaacgccccacgaccgcggcatcactcaccgccagcatcggcggcgtatcgacaatcaccagatcgtaatggtcgttcgcccattccagtaattgacgcatccgatcgcgcatcagcagttcagacgggttaggtggcacctgaccgcgagtaatcacatcaaagcctcctttgccaaaatgctggatcactttgttgagctcatctttacctgccagatattccgacaagccatgttcattactcacggtaaacaggttatgcgaataaccacggcgtaagtcggcatcaataaataacactttttgatcggactgggcgatcaccgctgccagagttgaactgacaaacgttttaccactgtctggcgtcgcaccggtgatcattagaatgttattctccgtctccatcatagcgaaatgcagactggttcgtagcgcacgtacggcttccacagcagaatccgccgggttatccaccgccaggaaggggatatttttagtacgatggcgctgctgattagaaaataaatttttcttacgcagacgggtgcgtttatccagccactcggacattgggatagtggcataaacgctgatgccgtgctcttccagttgttccggggcttctacaccacgacgcaacatcgcacgcgccagcacggcacccacagaaataaacaggccaagaataaaaccaagcaccacgttcaacgcttttttcggtttcactggctgcggctgagtgactgccgggtcgataatccgcacgttaccaatggcactggatttcgaaatactcaactcctgctggcggttaagtaattgcagatataccgcacggcccgcttctacgtcacgacttaaacgcaacacttcctgttgggtggaaggcattgccgatacccgcttattcaggcgtttgcgttcttgctccagcgtctggcgtttttccagcagcgcacgataagttgggtgatctttcttatacagctgggagatctctgcctcgcggaaggtcagctcattgagttgattatcaacgttcacaatctgctcaagaacggctttggcttccaggttaaggtcaaccgaatcgcgctgctggcgataaacgttgagtttttcttccgcttggtccagctcgctgcgcacttcaggtaactggcgctgtaagaattcaaggctttgtgaatcctgcgccgcctggcgagcgatattctgttgcaaatagttgttagcgatgctgttcagaatacgagtaatcaactggggatcatcaccagtcatggtaagttccagcatcccgctttctttactgcgttcgctaacggtaaaggtttcctgcaatgcgttaatcgcttccagttcggtacgctggctcaggacaaactgtgttcctggtttggccttaatgtccgcgatagtcagcgcaacgccatctttttccagacgctggccgaccataccattgacggtgaactcttcaccttccagtgtatagtggccgttttccccaaccgtgagtgtcagttgctgatcctgaccattcagttgtggaatatgcatccagctgatcgccagctcacctggtttttctttggttaatctcgcccagccgcgacccacaatcggaaaatacttctgctcaactatgtcgcgcagattcagttcagcaatggttttaccgagaatcatgcgcgattgcagcagttggatctccggtgcagactcgggcgatgagttagggatcatatcgctcaggccgctgagaatggcgttgccctgtttttgctcaacctggaccagagtatctgcctgataaattggtgtgcttaacagcgagtaagcgacagcgatcagcgtgaataacgcggtcacgctgataataaacttacggtgatcccataactcgccgaccagacgaagcagatcgatctcattttcctgagtgctgcctggtggcgtattcatatttttagttgtcatcgtattttataaactcaaattaccggctgaggcgcttcgcccattcctgactggcgcgctccaacataccgtagacatgttcaaatgcgtcctgacttttacgatagggatccgggatctctttctgttccagccattgcccaaacagcattgtcttcccgcggacctcgggagcaattgcggtaacctgagcaatatgttccgactccattgccagaatcagatcgtaatttcgtgccatctcagcagtgagcttacgtccggcatgtccttcaagagatacgccatgattagcggcaacatctgccgctgtcgcatctgcagggtgttttaccagaccatgaacacctgccgatttgacttttacgcccggcagacgtttacgcagcaagcgctcgccaatgggcgaacggcaaatgttgccggtacaaaccaccaggattgagttaaattttagttgggccatgtttgaatccaccgtgaagtctctgtcaggtcatgcaccccggaaatcgtcggtaccagcagagaaatcacacggttccaacgagccagcggcgcggtagtgacataaacaatgtcgtaaggttcaagctggaattccgttccgagtatcattgccgatgcgtccttcgcattcagctgataaatattggcgattttgccattctgcttgttttgcgttgcacgaataacaaaaatccccgtcgcatcagcgacatcctgattcataccctcagcgttacccagcgcttccgccagggtcataccgctgcggtccattttcagcgtgctctgtttacccacttcacccatcacgaagactttcagatcatcgttgcgcggaataaataaaatatcgcccgggtgcagcagtttgttctggcgcaagtcgccacgctgcatcagcgcatagaggttcactttggtctttacgccattctgggtgagcaccacgttgcgccagtctgcatctgcggtcagaccgcccgcggcgttaatcgcatccatgatggtcagaggaatattggtaatcggctgctgacccgatttgctgacttcgccggtgacgtacgctttttgcgatcggaacgccgcgacgctgacatcgacttgcgggctttcaatgactgaatcgagacgcgctgtaatctcgttgcgtacctgggtaagtgttttcccggccactttcaggcgaccaatataggggtagaaaatcgcaccatcggcgttaacccagttgccggtatcactggcgctacggtattgccctgcgggggtggttagttccgggtgatcccagaccgtaaccatcaacacatcaccaatcccgatacgatattcatagtttgcgatttgctgctccagctccgggttagcctgcgacataatcggtttggcgcgcaactgatcaatcaatcctggcgtgacgggatagatattgaccattttgtccaggtcatactgattgtcaggtagttcaatgacatccttgttactggtcgataaattctgaccaggaacaagggtacatgctgtcaaagacagaacagccaatgtcagtaccgaaaacttaaaaatgttctttttcattggtttatatttatcagtcaatgtaatgttatgaattacgtcaggttattgtccaaccggtacttctcgctctgccgtcattggatagagctggtatttgcgtgacagcatttgtccaccatcacgcgtcaatggtgtccacgaaaccaccgcgcggttgcggttaggtccaatggtcatcaagtcgaatggaatcgagatataaaaacctttactaaagccgccttcgccgtagtcatctttagatacgttactgattgccgcccatacccctaccgccacgccgctgtcaaagcgtttggcgacgtcgatcgttgcgcctttatcttttgccagatattgcccaacgctaagtttcatcagtacgccattgagcgtcggcgggttccagtaagccgtcacgaaacctgttggcgtggaataatcggtgaaacgcatcatgttgtcccagtcacgttgcttcacgtagttaacgtccacacccagcgcccagcaggcatctagcgggcgataaagcagctcggaaccgacaccggcgtacatcgtttccagataaccgccatacacctggccatagaaaccattgcctaagtcagcaaaatagttcgcctgcaagttgttgagataaacgtcattgcgaacgtagtcacggatatgcgtgcgcacgcggggcagggtagagtccgcgggcaacagcgaagacttaaacttgtcgtagttgttgtaaatattggtgaaaataccgccatcaagcagcaggtggtcggtaaaccagtagcgggcactggacatcagccccagctggaacatatagaaatcttccgggccgcccagcgactgtgaaagtgttgggttgaaagagtagctaaagcgatcttcacgaatacggtagccccgaccaaaggcagaaagatcttcagcttcaacacgttgttgttgcagtggctctgattgaccaggcgctgtacctgccagctgtttgcgcaggctggctacgtcggtttcggtagtcaccatcgccatatgctcgcgcttttgcgtcacgctaatcttctcaacgccttgcggcaggttattcaccagaatccggttggcacgatcgaccgcttcacgagagtcacggtatttgtattgctgaccagacatatacagtgtcttatcgcgtagctgaatttctggcgcgtcaaagcccgcgttatacttcagggcggtaagttggtttgctaccgtggtgtactgcaatccttcagattcaggcgcaggttgatatgccggttttggcgtatcgcgcagggcagggcgcagatcgttgaaattggtccgtaacgtgaagccaaacatcaacgtgttaccgcgttcataactcaggttgagatctgcccagctggcagcgcgataaactgcgccgacgttgaaatggcttgcctgaggcagtttgccagcgaaatcattctggtaattgtttccatcgtattcgagtttcagacgcaggggattccacggcgtttgatactcaatgccgccaaagatggaagccgggccacgaaagatatcgctaaagctgatatcgcccgcatcgtgagactctgcgcgatgacaatatttatcgctcacccggcaaaacgggttggtaatattgcccgcattaccggcgtagccccatgccatcccgagggtgaaatcaaatggccccgcttgcttgctggccaccagatactcaccgtcaaacagacccgtaccagcaatatcacgtttaccaaacgccacttgcggtagccagtaaccttcttcccacaggcgaagtttaaaatcgaatgatttgtctttgtatgactgatcgccgctgaaatcttcccactggctatatttgcgtgtgcgcacatccgtataacgaatggtgccttccagccatgggaacagcgccacggaggtggagtagaaccggtattgatcgttatcccggtagttgacgctgaattcaccttccggtgcgatgcgcgcatttggcatctgcaacaatcctgtgccgccaaagtctgattgcgacgaacccagcggatccgggtaggttaatacttcagcatgacaggcactggagacggcaatggccaggcagcttaaaagataagaattcttcttcatcagtcaggaacacgttgcgttaaaacagacacaatctggtcatttaaatcagcatatttttcgggcagtacatgcgcagaaaagcccaaccaaagctggctgccaggcggtggttccacatgtcttttattccacagggcaacaggggcgacgacagtctcaccctcaggcgtaatcaccataacgttattcttgtccgcgcctgcaaggcgggggtgatcttgcagataatcggtaacgctacggcctgcctgccagggcaattgcccggccccagaaaccgcacccagcagagtaatagtcaccggacgctgtacggtatagagcgtatagtccccgaccaacgggggattgctgttctcatccactcgtacaaaatcagggtccagtttgaccggtaagcgaccagtgatattgagattgagtaactgctggcgcacggatttaatcgttgccgccacatcgtcgtcagcttctgcttcccaggaagcaagctgtgccatgacatgttggtagtctttaagcgctttagctttcgccgcagagtcggtcagcaaggcaccaggccaccagaggcgatcgcgcagttgcggttgtgtcaccaactggacaacattttccacggggccaacggaaagtgtctgttgttcgccaggcagataaatagtcaccgttccttgcgcaaaggcatggggtgtcattacgtaaagtacgctggcaatgaaatacgactgtaatttattcatggtgcgggtttaagaaacgtcatttctacgggaataacccctgcgcctaacatttgccgactttgacgaacctggccagtagccgaatcgacccagaatgtgttttgccactgtttttctggccgcgtggaagtcacctcttcctgccagacattacacagcacattgcgacccgcaatattcagcgtctctaatccagcaaaggaaaaagtagaactcagggtcgcagagcgaaaatggttgtcttcactccagagaatatcgcgcgtccagcggctgccatcttttattgccagcgcgttacgcagagggtcctgcccggaatttgtcacttccagcagattattattaagtttgacggtttttaaaagacgtccattgtgggtaaccagcatggcgttatcctgggataaccatttgctttgttcttgttctatatatcccagtaccacaaagattcgttgcccttcattaaggcgtaaatacatagtggaataaggcaacgcctggatctgctgatccgctacggtgatatcctgattatcgaaaaggctggcgcgaaatgtatcgaccatactttgctggctgtgcgtacatcccgcaagaaatagtgcgaaaatcgataaaataagagggcgcacctttaatccttgaaaggttaattaaaaaaatgcaaatctctaaagcccggtacgaatatcgcaaccgggtatcatttaactttaatttcgacgcgttaaagcagtattagcgtgtagtggacgtggtggttgaggtgttatgagaaccgccatcgccactgtcatttgctgcaacaactgccaacgtcgccacaccaacagccgttgccacaccgacaactgtcgccgtgccgacagcgccagcagccacgccaccagtggtagtagcagtcgtggttgcgccggtagtggtcgttgtggtgccagtagtacccgtcgttgcctcggtcccgtttgttgcttcaggggcagcaaacgcagctggcgtcgtcaacatgaaggccataaggattgcagaaagcttgtgtttcataacttttcctttattcatcgcatggacaatacgggtgatgctgccaacttactgatttagtgtatgatggtgtttttgaggttctccagtggcttctgtttctatcagctgtccctcctgttcagctactgacggggtggtgcgtaacggcaaaagcactgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttccgccatttaaaaaactcaggccgcagtcggtaacctcgcgcatacagccgggcagtgacgtcatcgtctgcgcggaaatggacgaacagtggggatacgtcggggctaaatcgcgccagcgctggctgttttacgcgtatgacaggctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggtataacctgaatctgaggcagcacctggcacggctgggacggaagtcgctgtcgttctcaaaatcggtggagctgcatgacaaagtcatcgggcattatctgaacataaaacactatcaataagttggagtcattaccgacaatacgtacgcttgagatcaggattgtctactttgagtataacatccttgtgaaatctccctttcctcataccgcttgcactatatactgcgggtaggaaaggcgcgcagagggaaatataagattgttaactatccccctctggaaatacgacttgtgagcataagataaatcttagcaaaatacaaattaaagataaggaaattgttacgaaagctattaattattgttggtaatatagtttcaagtggtactataactggctgttaaatggcatttataactattaggtgcagagatattcgcttaaatggattagtttctttgtggaaaagtaactgatgttataatgtatgatgttgactatttcactattccaataaaaccagtcagctttaaacaagcagcgtcatattaagagagataaacatttgccgctgttggtcctcgcaggccatttacgcggcaaaattccacacgtaatcctggtataagcacttctgcgtcgcggggagtgaatgcggaaatatggacctgaacttctttacgaccgtcggaggggataatgaatcctttgccgcttttgcgatcaaaggttttgacaattcctgtcattttacgggacaaacaaattccttactgaaaatactgcgctgcactatacggggttaataaaataaagccagcgatatttaagaccgccggacggctaaaataaaatttgcttaatctcaattatcatgcgttaatagctgcgtcggtttgaaagacagacagcatacaaagtagtttactaaagcagttctcattatcaggcattatccccttcttttgagtctctctcctgaacactaagtagtttctgtattaaagccctgtttgccgaaaggcccaaaatgaaggaagtaaaatatgtctaataaaatgactggtttagtaaaatggtttaacgcagataaaggttttggctttatcactcctgatgatggcagcaaagacgttttcgtccatttcaccgccatccagagcaatgaattccgcacgctgaacgaaaatcagaaagttgaattttctattgagcaggggcaacgtggccccgcggcagcgaacgttgttacgctctaaggttgccattattactcaacatctccatttccgctgtccatgttgtcatggttcacagtaccgcacatcggcattcgatgtgacggagcgaaaccctttgggcgctaagtgtattttttgtaaatcgacgatgatcacctttgataacgtcgcgctgcaaatacgcactgaccatgcgccgctggatttcacaaaataatatcaggctccctcgtggagccttttttatatctgccttatttttcttcaacgctgtatgtatagtaagcgataacctgttgattattgaatctttcggggagatggcttataacatttcttacctgaccagggtaccgggaaccaacaccttactggcgtgttgctgtcttttaagaccagaagaggttaacagtgaatattgaagagttaaaaaaacaagccgaaacggaaatcgccgactttatcgcgcaaaaaatcgccgagctgaacaagaatacagggaaagaagtctctgaaattcgcttcaccgcacgagaaaaaatgaccgggcttgaaagttatgatgtcaaaatcaaaataatgtgattttgtgaacatcaccccgtgcgaggtgatgttccgcttgttgctaatttagtgaccaatcattggcgcttgtggaattaagcgtcggtacaattcctccggcaccgggctttgccatactcccgcatacattgcgtaaccaatcaccgcaaacataatccccagaaccagtagcgtcattaaccagccagacaacgcaaaggcttttttatttgccgcaggtttttgcagtgaaaaggtcaatgttgaggctaccggacatgactctacgcaagtcatacagccggtacattccactgttcgtacctgaattaatttatcgaccgggatccgtgatgggcaattttttgcgcatttgccacagtcgatacaactttcggcattgcgacgaatcttaaacggcgacaatagcgaaaccacgcccatcagcgcgccatatgggcaaagataacgacaccaggcatggcgaataaacaggctggcaatcagcaaaacggtcacgctgattaatgtcgcggtccccatatgacgaaagaaatcgagcattttaacgtccatcaccacgctgtagggcgacaacataaaatagtgaatcgcctgagcgggcatcaataacgcgatatagataaaaaaactcaacagcaaatacttcacgccgcgcagaggaatatccagccagcggggaaggacacattgccgaccaaacagtttgttaccgagatcgccgattaattcagaaagcgtaccaaccgggcataaccatgagcaaaaggcctttttgagtaatagactgatgacgataaaagcgaccaataacagcatcgcggcggcgtggacggacggtaactgacctgttacaaggctatatttcagattcatcagcccggcaatcggtagccagccttcgatacctcccggtctggcgacaaatgtcgtgctacttgccgtttcgtaatagcgcacccaataccagaacgtgatggcaatataaatattcattgccaacagtaataattgcgtcgctttacgccaggtcgtggcattacgccagtcattccacggtaatttgccgcccgtcgtgcctggccgccgctgccagcgggttcttttattctctgccatgattttgccagtccgttaagttgtataccaaatgccactattctagttgttcttaactggctgatattgattcaaatcgcgttcaggtctttcttatgcaaccatgcttccagagcggcaacactgcgtgtaatttcttcgtgtggaaggggggcagataatggctgctgctccagttgtgcgcatagctggctggcgatatgcattcccagactcgagcaactgctttttagctgatgcgcggcacgctttattttctcgctatcctgactggcgcgggcaatgtcgatttcatcgagaagcggcagggcatgttgtgtaaataataccagccattcgtggatcttctccgtccccattaactgagcatcttcattgagttgcgatacatccagcgattgatcattattgacttgcagttggagatagtgcgccagtaactgaccgagcacttcacgcggcaccggtttagggataatcccgcggaataatgaactggtacgctggcgcagcgtttcgtcaatgacatgggcgctaaagccaatcaaaaccagcgacggatattgctgtgccagttgtcgggcaagcgtaatgccgtcgatatccggcagatcaaaatccaccagtgcggcagcaaacggttcgctattttgcagtgtctctaaagcctgcgcggcattgccaacagcaacaatctgcgcaccactggttttcagcatctcaatggtaattcgctgggttagcgggttatcttcaattaacagcaaacgtaaaccgtcaagacgcaccgcctgattgactgtttttggcacgggtgccgtggcaacacgtaacggcaagcgtaaacaaaaacagcttccaacctccggcgtgctggtggcgctcagttcgccgcccatcgcctgggccagacggctactgatagtcagtcccagcccggtgccgccgcgtttgccgcttacctgcacaaatggctggaagatttctgccagtttcgcgggatcaataccgcagccgctgtcttccacttcgaccagccattgctcgccatcagtgcgactacgcaggataatgtacccttcgtcagtaaaacgcagggcgttgctcaacaggttggttataacctgacgaatacgtcgtggatcgcccattaacgcgcacggcatatcatcggcaattgccgttgccaggcgaatcgggcgacctttcacccgtccgctcattaattgcagggtactttccagcagcgggcgcggttcaaagggctcatcgctgaccgaaacattcttgccacctgcttcgatagcggaataatcgagaatatcgttgaggatggtcagcaacgattcaccagagtcagtaattgcccgcaaatcatcacgctgggcgttaagtgcggggttatctgccagcagttgagcagtgccgagaataccgtacagcggtgtgcggatctcatggctcatcgccgccagaaacgccgattttgcctggctggctttttctgcttccgcccgtgcctgtcggtgttctatcaccagttcctgcaattcagctgtacgcgctttgacctgcgccgccagctgttcgcggtggcgattcagtgcatgaacattgctgcgaaacgcatccatcagccgcccgatggtatccagctcccgtacgccagcggtttccgggaaaggggagtcaatatcaccgtccagcagccgttgcagcgcctgcgtttgttcggcaagtggacgcgtgactgagcgataaaccacgcgccagaggatcagaatcagtgcgcaaagtgaaaccatccccagcaataacaggctgtattgcccgcgtgcactcgctttttccagatgcgccagtccgtgctgattacgcagctcaatggtgtcgaccagctgactgacttcgctactaaactgcgcgaactgggcgatgttattttgtgcgagagtttgtaggtgattgctgatttcactgtcctgctgatacagcgccagcaaatcgctatattggctaacggtagttaacgttgttgcgacctgcgcacgaacacccggatcttcaatgcgtatttgccgacgttgcagaattttcaccgcattattgagctgcttttccagcgttggtgcatttttctggatctgctccagccccagattcatcaccatttgctgcacccgcagagcgctaaggcgcagttcattcatctggttaacatactcaagatcgatatcaatcagccgatcgagtgcactttcagcagcctgacgctgatcttgttcgatcaaatcgtaaatcccggcctgggtcgctccagcggaagttgtcgcattattcgcctgaccttgcgccaggcgtgcgatctcatcggcggcagcgactatctgctgactgagttgctgttgttgctggcgcagttgcaaacgctgccccaccagttccccttgctgacgtaacgaacgggagatctcctgctcctgttgttcaatagcggtggtatcaaaaccttgttcccgtaacgcttgcagcaacgcattaatcttcaggctttgtgcggtgagcattcgcccctgcgcctgccacatcttttcgttatcggcactggtcaggttctgcgcggcgaaaagttcccaggcgctggcttcgctcaactggcgcgccatattcatggtaggaatcaatgcctgagtgttgtctttttccacctggctgataaagcgcaggttgtaccatcccaccagggtactggtcagggttaacagcgccatcagggcaaagcccatccagagtcttcgggtcagggttaaattcacggtcggtgcactttaggtgaaaaaggttgagtcgcaaagcggaatgcatctagcataaagccttattattgatgaggctatcatgcgcgtactgctatttttacttctttcccttttcatgttgccggcattttcggctgataacctgttgcgctggcatgatgcgcagcatttcacggtgcaagcctctacgccgcttaaagccaaacgcgcatggaaactgtgcgcgctttatcccagcctgaaagattcatattggttatcgttgaactatggtatgcaggaggctgctcgccgctacggtgtggatttaaaagtgctggaggcaggcggctacagccagttggctacccagcaagcacaaatcgaccagtgtaaacagtggggcgcagaggccattttgctcggtagtagcacgacctcatttcccgacctgcaaaagcaggtagcaagtctgccggtgatcgaactggtaaatgctattgatgctccccaggtgaaaagccgcgttggtgtgccctggtttcagatgggctatcaaccggggcgatatctggtgcaatgggcgcacggtaaaccactgaatgtgctgttgatgcccggacccgataacgccgggggcagtaaggagatggtcgagggttttcgcgcagccattgccggaagcccggtgcgtattgttgatattgcgcttggtgataacgatattgaaatccagcgtaacctgttgcaggagatgctggaacgccatccagaaatcgacgtcgttgccggaacggccattgcggcagaggcggcaatgggggaagggcgtaacctgaaaacgccgcttaccgtggtgtcgttttatctttcacatcaggtgtatcgcgggctgaagcggggaagagtgattatggctgccagcgatcaaatggtctggcagggggaactggcggttgagcaggccatcaggcaattacaggggcaatcggtttctgataatgtcagcccaccgattttagttctgacgccgaaaaatgccgaccgtgaacatattcgccgctcgctgtcaccagggggatttcgtccggtctatttttatcagcacacatcagcggctaagaaataaccttcaccatgttgcgtcaccagtaaatccgcgctgagtttatgacgtaaacgacgaattaacacatcgacggtgcgcaggtcagggttttccacccgacgcgcagaaagcatacgtagcagacgttcacggctgagaatttcgcccggattcgtcacaaatgccaccaacatttcatactctgcgcgggtcagtttaatcggctcgccatcccgctccagcgtatggcgcgacacattcaggcaataaccggcaaagcgatagcagttgtcctgagtgtgcggttgagcttgtcgcgcgaggtcgattcgccagagcagatttttcacccgtactaccagttcgcgcagttccagcggtttggtgacgtaatcgtctgcgcccatttccagcccaacaatacggtcaatccgatcgctgcgtccggtaaccagaataatccccaccgttgagcgttctcgcagggcgcgggttaacatcaggccattttcatcgggtaagttgatatccagcagaattaaatctaccgactgattctgcataatttcccgtagcccagcaccgctcgccgtaacggaaacggtatacccctcctgagtgaagtaggattgtaatcgcgcctgggtaaccggctcatcttcaacaataacaatgtgatgtggcatcagagggttttactcattctgttcatatctgttcatattctgccgtaagccgttcatcctgaccagtgccgctgttcatatttgctcattaagatcgcttcactaaaccataattctacaggggttattatgcggaaactctggaacgcgctacgccgacccagtgctcgttggtcggtactggcgctggtcgcaattgggattgtgattggcattgcgctgattgtattgccacacgttgggatcaaagtcaccagcacaaccgaattttgtgtcagttgccacagtatgcaaccggtgtatgaagaatataaacagtcggtgcatttccagaacgcctccggcgtgcgagctgaatgccatgactgtcatatcccgccggatattccaggcatggtgaagcgcaaactggaagcgagcaatgatatctaccagacctttattgctcactccattgatacacctgaaaaattcgaagccaaacgcgcggaacttgccgagcgtgaatgggcgcgaatgaaagaaaacaactcggcaacctgccgctcctgccataactacgatgcgatggatcatgcgaagcagcatcctgaagcagcacgtcagatgaaggtggcagcgaaagataatcaatcctgcatcgactgtcataaaggtattgcccaccagttaccggatatgagtagcggcttccgtaagcagttcgatgagctgcgcgccagtgctaatgacagtggtgacacgctgtactctattgatattaagccaatttatgcggcgaaaggcgataaagaagcctctggttctctgctgcctgcttcggaagtgaaagtccttaaacgtgacggcgactggctgcaaattgaaattaccggctggacggaaagcgccggacgtcagcgtgtactcacccaattcccaggtaaacgcatctttgttgcctcgattcgtggtgatgtgcagcagcaggtaaaaacgctggagaaaaccaccgttgccgacaccaataccgagtggagcaagttgcaggccactgcgtggatgaagaaaggcgacatggtgaacgatatcaaaccgatctgggcttatgcggattcgttgtacaacggcacctgtaaccagtgccacggcgcaccggaaatcgcccactttgacgctaacggttggatcggcacgctcaacggcatgattggctttaccagtctcgataaacgtgaagaacgcaccttgttgaaatatctgcaaatgaatgcgtctgacaccgcaggtaaggctcacggcgataagaaggaagaaaaataatgaacaataacgatctctttcaggcatcacgtcggcgttttctggcacaactcggcggcttaaccgtcgccgggatgctggggccgtcattgttaacgccgcgacgtgcgactgcggcgcaagcggcgactgacgctgtcatctcgaaagagggcattcttaccgggtcgcactggggggctatccgcgcgacggtgaaggatggtcgctttgtggcggcaaaaccgttcgaactggataaatatccgtcgaaaatgattgccggattgccggatcacgtacacaacgcggcgcgtattcgttatccgatggtacgcgtggactggctgcgtaagcgccatctcagcgatacctcccagcgcggtgataaccgttttgtgcgcgtgagctgggatgaagccctcgacatgttctatgaagaactggaacgcgtgcagaaaactcacgggccgagtgccttgctgaccgccagtggttggcaatcgacggggatgttccataacgcttcggggatgctggcgaaagctattgccttgcatggtaatagcgttggtacgggcggagattactctaccggtgctgcgcaggtgatcctgccgcgcgtagtcggttcgatggaagtgtatgaacagcaaacctcctggccgctggtattgcagaacagcaaaaccattgtgctgtggggctccgatttgctgaaaaaccagcaagcgaactggtggtgcccggatcacgatgtttatgaatattacgcgcagctaaaagcgaaagtcgccgccggtgaaattgaggtcatcagcatcgatccggttgtcacatccacccatgagtatctggggcgcgagcatgtgaagcacattgcggttaacccgcaaactgacgtgccgctgcaactggcgctggcacatacgctgtacagtgaaaacctgtacgacaaaaacttccttgctaactactgtgtgggttttgagcagttcctgccgtatctgctgggtgagaaagacggtcagccgaaagatgccgcatgggctgaaaaactgaccggcattgatgccgaaaccattcgtgggctggcgcggcagatggcggcgaacagaacgcaaattattgctggctggtgcgtgcagcgtatgcagcacggtgaacagtgggcgtggatgattgtggttctggcggcgatgctggggcaaattggcctgccaggtggtggttttggttttggctggcactacaacggcgcaggcacgccggggcgtaaaggcgttattctgagtggtttctccggctctacgtcgattccgcctgttcacgacaacagtgactacaaaggctacagcagcactattccgattgcccgttttatcgatgcgatcctcgaaccggggaaagtgatcaactggaacggtaaatcggtaaaactgccgccgctgaaaatgtgtatttttgccggaactaacccattccatcgccatcagcagatcaaccgcattattgaaggcttgcgcaagctggaaacggttatcgccatagataaccagtggacctcaacctgccgctttgccgatatcgtactgcctgcgaccacgcagtttgagcgtaacgatctcgaccagtacggcaatcactccaaccgtggcattatcgccatgaaacaggtggtgccgccgcagttcgaggcgcgcaacgacttcgatattttccgcgagctgtgccgtcgctttaatcgcgaagaagcctttaccgaagggctggacgaaatgggctggctgaaacgcatctggcaggaaggtgtacagcaaggcaaaggacgcggcgttcatctgccagcgtttgatgacttctggaataacaaagagtacgtcgagtttgaccatccgcagatgtttgttcgccaccaggcattccgcgaagatccggatctcgaaccgctgggcacgccgagtggcctgattgagatctactcgaaaactatcgccgatatgaactacgacgattgtcaggggcatccgatgtggtttgagaaaatcgaacgctcccacggtgggcctggctcgcaaaagtatccgttgcatctgcaatctgtgcatccggatttccgacttcactcgcagttatgtgagtcggaaacgctgcgtcagcaatatacggtagcgggtaaagagccagtattcattaacccgcaggatgccagcgcgcgcggtattcgtaacggtgatgtggtacgcgtctttaacgctcgcggtcaggtgttggcaggggcagtggtttctgaccgctatgcacccggcgtggcacgaattcacgaaggggcatggtacgatccagataaaggcggcgagcctggtgcgctgtgcaaatacggtaaccccaacgtgttgaccatcgacatcggtacatcgcagctggcgcaggcgaccagtgcgcacactacgctggtggaaattgagaagtacaacggaacagtggagcaggtgacggcgtttaacggccccgtggagatggtggcgcagtgcgaatatgttcccgcgtcgcaggtgaaatcatgaccacgctgacagcacaacagattgcctgtgtttacgcctggctagcgcagttgttctcccgtgagctggacgatgaacaactgacgcaaatcgccagtgcgcagatggctgaatggttttcgttgctgaaaagcgaaccgccgctcactgcggcggtgaacgagctggaaaaccgtattgccacgctgacagtacgtgacgatgcccgtctggaactggccgcggacttttgcggcctgtttctgatgaccgacaaacaagcggcgctgccgtatgcatcggcctacaaacaggacgagcaagagattaaacgcttgttagttgaggcagggatggaaaccagcggcaatttcaacgaaccggcagatcatctggcgatctatctcgaattgctcagccatctgcatttttcgctgggagaggggaccgttcctgcgcgaagaatcgacagtttgcggcaaaaaacactgacggcgctgtggcaatggttaccagagtttgttgcgcgttgtcgtcagtatgacagctttggtttttacgcggcactaagccagttattgctggtgttagtggagtgcgaccaccaaaacagataacgtcgtttgtgcgcctgaaaagacgcgtttagcgtcgcatcaggcattatggcgcagttgccggatgcggcgtgaacgtcttatccggcccacaggaactgtaatctttgtagaccggttaagatgcgtcatcgcatccggcaaacacacatcacggatgagctacaaaccgggaaagccgctggcgcagcaggcggttttcctgcttcaggtgcgcaatatcatccattaacgtcagcgccaccgcgatccccggccagtccagagccagttcatgacgcaggcgtaccgcgcgttgcaccacaatggcggcatggtcgtcaaatacccaggttgtttcctggatctcacgcggttcaaccacccccaaaccgacaatttcattcaactcctcttcagagatgccggtatgcaggcaaaattcggtaatagtaaaagtcaccgtaacattagccattatgctttcccccaatctttacgtggatcaaaagacgactgggcgtctgccagttgctgccacagcgcggcagtgttttcatccggtttcggcggcatcacgattttcagtaccgcatacagatcgccggtctgttttttgctcaccagacctttgcctttaacgcgcaatcgttgcccggcctggctgcctggcgggatagtcagcaaaatgctttctttcagtgttggaacggtgactttagcacccagcgccgcttcccacgggctaaccggcaccacaatttccagatcctggccgacaatatcaaacagcggatgtggcgcaatatgaatcaccagccacaaatcgccatttggaccgccgttttcgcccggcgtcccctggcctttcagacggatgcgttgaccattgccgacgcccgccgggatcttcacattcagcgttttcggaatttcctgttcgatcatgccaaaggcgttataaaccggcaggttatagctgatggtacgcttatgctcagtaagcgtttcttcgaggaataccgccacttcgatttcaatatcgtggccgcgtgtggcggggcgttgacggctctggcgggcatgctgaccgaaaattgacgagaagatatcgtcaaaatcttcggcgttaaaactctgaccgtcgccatggtggaactgacggttaaattgcggatcgttgcgatgttgccacatctgatcatactcagcgcgacgttgttcatcacttaacacttcccaggcttcagcgacctctttgaagcgggcttcggcatccggttctttgctgacatcaggatggtatttgcgggcaagtcgacgataggcggtcttgattgtcttgagatcgtccgtcggtttcacgcccatgatggcgtaataatcctttaattccatagcgttatctcgcgtaaatcaacacaaattgaaggaacccctgtaaggtaactcctataagtgtagggtaatcctcaaaatttcatatgccaacacagaatatgttattgaaatcatcgcggagaggaggtcgccatcaagatgggttgctgaacatattttaaacaggtgaaaaagggtgagcgatttttgatagttgaaccaggcactttaagtttaactagggcgtcattatttattaaattttatagacgctatatatgggtagtaatatacatggaattagttgcactgcaaataattatttgaaacaggcctggaacgatataaaaaatgagtacgaaaaaaatcaaacatattcaatcacgctttttgaaaacacactggtgtgttttatgcggttatacaatgaactcagacgtaaagtaaatgaagaggatactccatgtctggaatgtgaatcactagaaaaagaatttgaggaaatgcagaatgataatgatctatcattatttatgagaatattgcgtactaatgatacacaaatttattcaggggtttcaggaggtattacatatactatacaatatgttcgagatattgatattgttagagtgtccttgccgggcagagcttcagagtctatcacagattttaaaggttattattggtataactttatggagtatattgaaaacattaatgcgtgtgatgatgttttttctgagtattgttttgatgatgaaaatataagtgtccagccagagcggataaatacgccgggaatatctgatttggattctgacattgatttgtctggtatatcttttattcagcgtgaaactaaccaggcattaggattaaaatatgctcctgtagatggcgatggatattgtctgttaagagctatactggttttaaaacaacatgattattcatgggcgctggtcagttataagatgcaaaaggaagtttacaacgaattcattaaaatggttgataaaaaaacgatcgaggctcttgttgatacggcattctataatctcagggaagatgtaaagacgttatttggcgttgatctacaatctgacaaccaaattcaggggcagagtagtcttatgtcatggagctttctgttttttaaaaaacaattcattgatagttgcttgaataacgaaaaatgtatcctgcatttacccgagtttatatttaatgataacaagaacttgcttgctttagataccgacacgtcggataggattaaagcggtgaagaattttcttgttgttctttcagatagcatttgctcattatttattgttaatagtaatgtggcatcaatctccttggggaatgaatccttttcaacagatgaagatcttgagtatggttatttaatgaacactggcaatcattatgacgtttacctccctcctgaactttttgctcaggcttacaagttaaacaataaggaaatgaatgcgcaactcgactatttaaatcgttatgcaatttaatggcaaaggcatatgctaaaaaccattgttattagtctcacacttttttattggtaaatattgtctctgtattggtaacgccgcagatattctgtttagccacaggtgcaattatcagcggcgtacgcgaggcaggggctaatcaggcatagtttgcgtcaaaccttgcctgtttttgaagatgtatatagaaaaacaggcgttcaacaagccattttgcgaacctgttcccggaaaaaagtcatatttctgtcacactctttagtgattgataacaaaagaggtgccaggaatgaacaaaacgctaatcgccgcagctgtggcagggatagttttactcgcttcaaacgctcaggcacaaaccgtaccggaaggctatcagctacagcaagtgctcatgatgagccgccataacttacgtgcgccgctggcgaacaatggcagtgtgctggagcagtcgacgccgaataaatggccagaatgggacgtccccggtgggcaactcaccaccaaaggtggcgtgctcgaagtgtatatgggccattacatgcgtgaatggctggcagagcaggggatggtgaaatcgggggaatgcccgccgccgtacaccgtttatgcctatgccaatagtctgcaacgtaccgttgcgaccgcacagttctttattaccggcgcattcccggggtgtgatattcctgtgcatcaccaggaaaaaatgggcactatggacccaacctttaacccggtgatcaccgatgattccgccgcattcagtgaacaggcggtggcggcaatggagaaagagctcagcaaactccagcttaccgacagctaccagctactggaaaaaatcgttaactataaagattcccctgcctgtaaagagaaacaacagtgttcgctggtggatggcaaaaatacctttagcgccaagtatcaacaagaaccaggtgtttccgggccgctgaaagtcggcaactcgctggtagatgcgtttactttgcaatattacgaaggttttccgatggatcaggtggcctggggagaaatcaaatctgaccagcagtggaaggtgttgtcgaagcttaaaaacggctaccaggacagcctgtttacctcaccggaagtggcgcgcaatgttgcgaaaccgctggtcagttatatcgacaaagctctggtcaccgatcgcaccagcgcaccgaaaattacagtgttggttgggcacgactccaacattgcctctctgttaacggcgctggatttcaaaccgtatcagttgcatgaccagaacgaacgcacgccgattggcggcaaaatcgttttccagcgttggcatgacagcaaagccaatcgcgatttgatgaaaattgaatatgtgtatcagagtgcggaacagttacgtaatgccgatgcgttaaccctgcaggcacctgcgcagcgtgtgacgctggaattaagcggttgcccgatagacgctgatggtttctgcccgatggataagtttgatagcgtgttgaatgaagcggtgaaataacagaaaactcccccgcgagaagcgggggagtcgctggttaaacgtttttacgttcgatggtctgttcgccccaaaaaagcgaatctttatcggtcttagcaaaggctttgactaacacttcatcactaccttcttcccaaatcttttccgccattttttcgtcgtacccggcgacttcgaaaatggcctcggctatttccggcgacgtattgcgcagagatgcccattcaccgacgtgatgagctttcgcttcttgagttggcatgcgtatcctcctgttgaagattagccgttaagtttaactgccagacctgcgacatattccccttgataacgagcaatagacagttcttcctggctgggctggcgtgaaccgtcaccgcctgcgatggtggttgcgccgtacggcgtaccgccgcgaacctgtgaaacgtcaaataattcctgcgctgcgtagccaatagggacaattaccatgccgtgatgcgcaagggtcgtccaggtggatgtgatggtttgttcctgaccgccgccagtaccggtggaactaaagacgctcgccagttttccgtatagtgcgccggaagcccacaggccgcccgtctggtcgaggaaggtacgcatttgaccggacatgttgccaaagcgggtaggtgtaccaaaaataatggcgtcgtaatcggccagttcttgcggggttgcaaccggtgcagtttgcgttttaccgcctgctttttcaaataattgcggcggcatggtttccggtacacgcttaacgacaacttcagcgccatccactttgcttgcaccctcagcgactgcgcgtgccatcgtttcaatatgtccgtacatggaataataaagcaccagaactttagccatttctaaccactcctcgtgttatctctattccgtagcgattcgctaccacttatttaaagataagacgtccttttcagagtgcaaatttcacaaccacttatttgatttataacaactttcacaagcacgtaattttgtcgcaaaatgacacatttttatctcatcgcgtttttttaatcataagagcggcttatggataattattggagatgatatctattctcgctaagaagctgttgcaggatattaccaaacgcgggtctgcccgcgtcagttcactaagcttagtcccacgtagcgaaaatatggcagccgccatacgccgcgttaattctatgcaatatgatgtctatacccagacggaggtcagtaatggcaaaccatcgaggcggttccggcaattttgcagaagaccgcgaaagagcatcagaagcaggtaaaaaaggtggacagcacagcgggggtaatttcaagaatgacccgcagcgcgcatctgaagcaggtaaaaaaggtggtaagagcagtcacggcaaaagcgacaactagccgggctaatcaatgacgaatgcatttttgtctgtagctcgtcaaaaagccatcaccgccggttacccggtggttgatactgatgacaaatgtaagcttgcctgatgcgcgatgcttatcaggcctaccagaagattgcaatatattgaatttgcactgttttgtaggccggataaggcgtttacgccgcatccggcatgaacaatgcgtacgttgtcaacaatctgcaccgccggtaaccccggcggttttctgtttatggctcctgatgaacaacttctggcggtggaacgtcaaccaactttctgcttaacaacgcattgagtaaaatcgcgccaaaggttgctgtaccaatccctcccaacgtaaaaccgcccagcgtgagagcaaaatcacccgcgcccagcactaaggttactgcgaccataatcaaattaccgttctggcttaaatcgacacggttttgtacccatatccttgcgcctgcgacggcaatcagcccgaacacaacaattgatgcaccaccaataaccgcggccggaatggtatgaatcagcgcaccaaatttcggtgaaaagcccaacagcatggcgatgacggcagcagcaacaaacaccagcgtcgagtagactttggtcacggccatcacaccgatattttcagcataggtggtcacgccgctaccgccgacagagccggaaagcatcgttgccagaccatcgcctacgaatgcccgccccatatacgggtccatattgcgtccggtcatcccggcgactgccttgagatgacctaagttttccgccaccagaatcaccgccacgggcgcaatcagcatcattgcctgaccattaaaagcaggagtggaaaaatgtggcagaccgaaccaggcagcatggctgacgagagtaaaatcgacggcttttcccagccctaaaacgttggtcatcacgccatacagcagacaggcgacaattaatcctacgagaatcaataaccgctggatcatgccacgggtaaacaccgccaccagcccaatacacagcaccgtcattaccgccatccagctatcaaaggccgaagccgatacacttttcactgcgataggcgctaagttcaggccaatcgccatcaccaccgcacccgtcaccaccggcggcatcagtcgttcaatccagcgcgtaccgattttcatcaccaccaggccaatgacggtataaaccagcccacaggcgataatcccgcccagcgcaatgctgatattcgggttaatgccctgaccgttaaagcccgtcgcggcgatcaccacgccgacaaaagccgcgctggagccgagataactggggacgcgcccgccggtaataaagaaaaacagtaacgtgccgatccccgacattaaaatggaaagattgggatccagccccatcagaatcggcattaacaccgtcgcgccaaacatcgccaccgcgtgttgaacgcccattactgccgtctgagcaaacggcaatcgttcatccggcgcgaccacgccgctctctgtagaggtcgattttaactgccagtgaggaaaaccgaacattgccatcagctgtctccttaaggaggttaacaagcagggcgcatcagcgcgtgataactgcgatcgaaccacaccagcccgtagggtgtggtgtgacgatgaatcgcttcgatggcgcaaaacagaatgtcgtgggtgccgacgctcaccacctggctgatacggcagtcaaacgaaaccagagcctcttccagttgcgggcatccggtcacccccgtctgccagcgggcggcggcaaagcggtgttccatgggcgttttgccgccaaaaaggtttgaaagcggctcctgcccggcgctaagtgtatttacacacagcgttcgattttcattgaatgccggccagacggacgccccacgattcaggcacaccagtaatgtgggcggcgtatcggtcacactgcagacggcgctggcggtgaacccggcgcgcccggctggaccgtccgtggtgataatattgaccgccgcgcccatgcaggacatcgcatcgcgaaaagtttgttgatcgacaatgttcatagtttgctccttacaacagcccgcaggcttcttcaaaggacagacgtggcaggcgcgcataaagcttgctgctatcgccatagccgatattaatcagcagattgctcttcagcgtgctgcccgtaaaaaaggcgtcgtccacgtgttgacggtcaaagcccgacatcgggccggtatccagtcccagcgcccggcaggcgacgatcagataggccgcctgcatggaactgttgcgaaacgctgtttcttcggcaagttgtgggctggaggtaaaccaactgcgggcatcaccgtggggaaacagtagtggtaaccgttcataaaattcactgtcccaggcgacgatagcggtgacgggcgcggtcagggttttttgcagattgccgctggaaagtgccgggcgcagacgttcttttccttctgccgtgcgggtaaacacgatccgtgccggagaacagttagctgatgtcggcccccatttcatcagggcataaatctcccgtaacgtctcatcgctgacgggtgtctcccgccagccgttgtgagtgcgggcatcggtgaacagggtgctaagcgcacctgggctaacggcttcgttcatagcaattccttacagggcggcttcacggtgatgtaacaggctggcaagcccgttgagtaacagagcattaaacgtttcgggatcggtcacgttgcaggcgtgtccgccatagggcatcaccattttctggctatcgggcagggcggcatgaagttcactggaacatgctgttggcaccagcagatcatcactggcgcagatgatttgcaccgggcagcggatgcgatccgcatggtgactaaagtcagcgcgtttgagggcgttaagtcgacgcagtaaattatttttgccctgaaaatgcgccagtgccagcgcgtcttctgcctccaggcgaggtgcgcgggccgccatccagtcggcgggatagaggaacaacggctgcgcttccacccatgcctgcgcgccgccgctatacagtaatcgttcgcgaacctgaaaacagcggcgcgtatgggcgtttattcgtagccagccgttaacgctgatcagcacagttaccgacgcgggataatccagcgccagctgcattcccaccagcgcaccgagcgcatggccgaccactgcgtaatgctcaatccctgcggctaccagcgcctgatgcagttccgctgccatctgggcgatactgtaatcttctgccagcgtgtcgggattattgccggtgccgcgctggtcgtaacagactacctgatactcctgctccagcaccgccagttgcggtaaccagtaactgccgctacccccaagacccgaaatcaacaccactacgggcgcatcagcataagggggaggtgagagtgaaagtttcatcgcggcctcacttggcgatatgcgcaattgtggcgatttccaccagcgcgtcaggttttaccagtccgcactgaatgcagaatcgcgccggtttatcacccggaaaaaactcggcgtagatttcgttaatcgcggcgtaatttttccagtcggtaataaagatgctgttgaaggtcacatccgccatcgtgccacccgccgtctcgatcaccttgcggatagtttccagaacgtggcgggtttgcgcctttgggtcatcggcaaacagcacgttattatgttgatcaaaagccagcgtaccggagacatacaccacgccatcagccagcgtgccgggaacgaagggggccagcggtgcgctgctgccagcgggaataattacggattttggcatcgttaaactccttaagcgatatgagcaaaggacgtgggagaaagcgcgtcgcagaatgtttcgacgtcgctgacccagccaaaaaaggtttcgatattgaacaacgcggctttctgcgcaaatttcggccccgcctggtgagttgcgtcttcaagcaccacgccgaaatactccagaaaaaagccgtcgcgtagcgtcgattcgacgcagacgttggtagcgatgccggtgaaaaccagatggcgtattccgcggctgcgcaaaatgctgtccagcggcgtattgaagaaaccgctgtagcgcggcttcggcagcacaatatcgccaggctgcggcaccagttcatccaccagttgataatcccaggagcctttcgccagcaatttcccctgcagctgcggctgcttacgcatggttttcagggcgttcgatttatgaaaattcggtgagccgggtccgccagcctcgacatactgttcatcccagccattttgaaaccagatgatcagcatccctgccgctcgcgctgcggtcacggcggtttgaatgttggcaatgaccgggcgagtggttgagacatcaaacccggcgagatctaagtagccgcctggcgtggcataagcgttttgcatatccaccacgatcagcgcactttgctgcggatcgaaggtaatggcttccggtcgagcggttaaggtcgtcatcatgccacctcctgagtcagcgcaggtagatgggcgcggcattgcatcagtggttgaatgcgctcgccgaaggtttcgattcccgacagaaaatcgtcgaaggttaacagcacgccttcggcaccaggcacgcttgcgacttcatctaacatgcgcgcgacactggcgtaagaaccgactaacgtccccatattgatgtttaccgccgaagtgggatcggccatctgacgaacgttggtgtcagtaccggagcgggtatctttctgactttgttcggttagccagcttaacgcctcttcatccgcgcccgctttgtagtgttcccatttggcgcgagcggcatcgtcggtttcatcggcaatcaccataaacaacacataagagccaacgtcgcgtccggtttgctctgcggcctgtttcatccgcgcagcggtcggggcgaaagccgtgggtgtatttacgcctttgccgaaacagaagttgaaatcggcataccgggcggagaacgccatgccagcgtcgctttgcccggcgcagatcactttcatggggacactcggttgcggactcacgcgacaatcattcatggtgaaaaaatcgcctttaaaatcgcttttccccgtgccccacaggtcgcgcagcacctgaacatattcggtgagatagtcgtaacgacgggagaaatagtcatcgccaggccagatacccatctgctcatactcgggcttttgccagccagtcacgaggttgacgccaaaacgcccgccagagatggagtcgatggttgcggccatacgggcgacgattgccggaggtaacgttaaggtggcagcagtggcgtaaatctgaatgcgcgaggtcacggccgccagccccgccatcaaggtgaacgactcaaggttgtgatcccagaactcagttttgccgccaaagccacgcagtttgatcatcgacagggcgaaatcgaaatggtagtgctccgctttttgcacaatggctttattcagttcaaaggtcggcatgtactgcggcgcgtgggtcgaaatgagccagccgttgttgccaataggtacgaatacgccaattttcatcatcaacctctcttcgtctcgtaaagtgaaagtcagacggggcgctgcatcctgcatatccttttcagccgcgtattggcttgtttgcaaagcggatgccagtttttaaaaagttaatgttattaatctgttaacattacgttatctaaaatatctggtaaaaagtggactaaacggtcaaaacagttgcacataaaacatgcatctgtgcgcgatgagagtgcagaaggtcgaggccgggcgggggttttgctatcctgttgccaatctacaagaggggagagcgcatgacgcaaggcgcagtgaaaacaacgggtaaacgttcgcgcgcagtaagcgcgaagaaaaaagcgattcttagcgcagcactggacactttttcacaattcggttttcacggcacaaggctggagcagatcgcagagttggcgggtgtttcaaaaaccaatctgctgtattactttccgtcaaaagaggcgctgtatattgccgtgctgcggcagattctcgatatctggctggcaccgttaaaagcgtttcgtgaagatttcgccccgctggcggcgatcaaagagtacatccgtctgaagctggaagtctcacgcgattatccgcaggcttcgcgcctgttctgtatggagatgctggcaggcgcgccgctgttaatggatgaactgacgggcgatttgaaggcattaattgatgagaaatcggcgctgattgccggttgggtcaaaagcggcaaactcgcgccgattgatccgcagcatttgatttttatgatttgggcttccactcaacattacgccgatttcgcccctcaggtggaggcggtgacaggcgcgacgttgcgcgatgaggtatttttcaatcaaacggttgaaaacgtgcagcggattattattgaggggattcgaccacgttaaagatgccggaggaggttgtaacatcctccggctacctgtttaacctatagtcattaagctggcgttaccgccagcggcagcggtattcacactcagcgaacgctcgatatacagccgttccagaaggatattgctttcgccacgggcaaaaccctgcaccgaaacaattgtgccatcccgcgcggcaactgcttcacacaatgcgcgaagctgatccgaatcaccgtggaagatcaccgcatcaaacggttgagcggttatattttccgctttcgccagttgaatacgttcgctgactgccgatggcaatgccttcactaactgacgatgcagcgcgtcatccggccacagtacctggctgcccaccgccagcacggcggcgagctgagtcagcgcatcctgctcatcatcggcaatacacaacacgcgctcacgcggcagcagcgtccaggtgttgcgttcacccgtcggccccggcagcaatcgttgtgttcctgcctgcgccagctcgccatattgcgtacataacgcctgcaattctggacgatttgctgcccattcccgcagtgcatttagcggctgagtcaatgcggctttcaactgcgcatcgaccggatactttgcatcctgacgcgcgagcgtcactgccagcgcactttccgggcgattcgccagcagacggtagagatagagcggaccgcctgctttcggcccggtaccggacaacccttcgccgccgaacggctgcacaccaaccactgcgcccaccatattacggttaacatacaggttaccaacatgggccgagccagtgacctgggcgatggtttcatcaatgcgcgtatggacgccaagcgtcagaccataaccggaagcgttaatctgctcgatcagctctggtagctggttacggttgtaacgcaccacatgcagcaccggaccaaagacctctttttgcaattcggcaaagtcatccagttcgatcagcgtcggggcgacaaaggtgccgctttgccattcacgggcatcttcgctgttttcccgcaccgcctggaacaccggacggcctttgctacgcatggtctgaatatggcgctcaatattggctttcgcttcgctatcaatcactggaccgatatcggtggtcaggcgacccggattacccatccggcattcggccattgcgccgcgcagcattttcaacgtgtggtcggcaatctcatcttgcaggcacagcacgcgcagcgccgaacaacgctgacccgcactgtcgaacgccgaggccagtacatccacgacgacctgttcggtcagtgctgaagaatcgacaatcatcgcgttcatgccgccggtttcagcgatgagcggaatagggcgaccctgagcgtccaggcggctggcgatattgcgctgcagtaacgtagcgacttcggttgaaccggtaaacatcaccccgcgcacgcgatcatcacccgtcagttgcgcgcccacggtttcaccccgacctggcagcaattgcaccacgcctggcggtacacccgcttccagcaaaatggcgatcccttgcgcggcaatcagcggcgtttgttctgccggttttgccagcacgctgttacctgccgccagtgcggcggcgatctgcccggtgaaaatagccagcgggaagttccacggactgatacacaccacaggccctaatggacggtgggtttcgttagcgaaatcatcccgcacctgtccggcgtagtagtggagaaaatcgaccgcttcgcgcacttcggcaatggcgttactgaaggtttttccggcctcacgcaccagaataccaatcagttgctgcatctggctttccatcagcacggcagcgcggtgcaaaatcgctgcgcgttcagccggaggcgtggcaaaccagattggcgcgttattaaccgcactttccagcgcctgttctacttcacgcggcgtggcttcacgcacatagcccacaatatctttcggttccgcagggttaataacgggcgacatctcacctgccgctaccggttgttccagcattggcaaggcctgccatttttgcagtgcactattgagcagggcagaggagagcgaggccaggcggtgttcgttagcgagatccagccctgccgagttgtcgcgcccgtgaccgtaaagatcgcgcggcaggggaattttcggatgcggtaatccagtttgcccttcctgttgcgccagtttttctacagcagtgaccggatcggcgaccagttcatccagtggcaaagaggtgtcggcaatacggttaacaaacgaggtgttagcaccgttttccagcaggcgacgcaccagatacgccaacagcgtttcatgtgtgccaaccggagcataaatacgacacggacggttaagtttgccgtcggcaactttcccggtgacctgctcatacagtggctcgcccataccatgcaggcactggaactcgtactgacccgggtagtagttctgccccgccagttgataaatcgccgccagcgtatgggcgttgtgcgtcgcgaactgcgggtagattagattcggcaccgccagcagctttttcgcacaggcgagataagaaacgtcggtatacaccttgcgggtataaaccggataaccttcaaggccgtccatctgcgcacgcttaatttcactatcccagtacgcgcctttcaccaggcgaatcatcagacggcgacggctgcgggtggcgagatcaatcaggtaatcgatcaccaacgggcagcgtttttgataagcctgaataacaaaaccgatgccgttccagcctgccagttccggctcgaaacagagtttttccagcagatcgagggagatctccaggcgatcggactcttcggcgtcaatgttgataccaatatcgtactgacgcgccagcagggtgagtgatttcagacgcgggtaaagctcttccattacccggtcatactgggcgcggctataacgcggatgcagcgccgacagtttgattgaaatgcccggcccttcatagatgccacgaccgttagacgctttaccgatggcgtgaatcgcctgctgataggaaaccatatacgcctgtgcatctgcggcggtcagcgcggcttcgcccagcatatcgtaagagtaacggaaacctttctcttccagcttgcgggcattggctaacgcttccgcgatggtttcgccagtgacgaactgctcacccatcaggcgcatcgccatatccacacctttgcggatcagcggttcaccgcttttaccgataatgcggttcagcgagcgggagaggctggcttcgttatgggtggaaaccagtttgccagtaaacagcagcccccaggtggcggcattaacaaacagtgacgggctacgaccaatgtgtgactgccagttaccgttgctgattttgtcgcgaattaacgcgtcgcgggtggctttgtcgggaatacgcaacaacgcttccgccagacacatcagcgccacgccttcctgcgatgacagcgaaaactcctgcaataacccctggaccatacctgcgcgaccactggcatttttttgattacgcagtttatcggccagctgatacgccagtttgtgcgcctgttcagcaactggctgcggcaggcgggcttgttccagcagcatagaaaccgcttcggtttccgggcggcgataggccgcggtgatcgcggcgcgggaaaccgactggggcaatatttgctcggcaaagtcgaggaatggctggtgtggttcctctgccggagtcggtgcttcatcgctctcattggccgcgccagaaagcagcgcaggtagctccggcagagtatcgctgttttccagttgttcgagataagaaaaaatcgcctgcttaattaaccagtgtggtgtgcgatcgatacgtgtcgcggcagacttaatacgctcacgcgtcgcgtcgtccagcttaacccccatggtggtggttcccatgccattactcctgttgttcagaaaggtgcaacttaacgttatcgtgaaatatccatgatgttgcaactttgtgcaaccatgttaaatgtgacatgcgtagcaagcttaaaaatgaatgaaatgttaataaaagaaatcgatatgacagggattaaaaaaataactcagactttttctctgcggcagttaacatttttgaaaggtgcaaccgcaaaaaatgtgagagagtgcaacctgatgaaaaatagtgtcgctgagcactaaaatttaatgtaaatggtgtgttaaatcgattgtgaataaccagcgcttccggcaggatacggtcgccctggtaaaacataaactctgttaccccgttccggtggcagatataacggcaagtttcgacattgccgataataattttttggagactttagatggctattagcacaccgatgttggtgacattttgtgtctatatctttggcatgatattgattgggtttatcgcctggcgatcaacgaaaaactttgacgactatattctgggcggtcgtagtcttgggccattcgtgacggcattatcggcgggtgcgtcggatatgagcggctggctgttaatggggttgccgggcgctgtttttctttccgggatttccgaaagctggatcgccattggcctgacattaggcgcgtggattaactggaagctggtggccgggcggttgcgtgtgcataccgaatacaacaataacgccttaacactgccggattatttcaccgggcgctttgaagataaaagccgcattttgcgcattatctctgcgctggttattttgctgttcttcaccatttattgcgcttcgggcattgtggcaggcgcgcgtctgtttgaaagtacctttggcatgagctacgaaacggctctgtgggcgggcgctgcggcgacgatcctttacacctttattggcggtttcctcgcggtgagctggactgacactgtacaggccagcctgatgatttttgccctgatcctgacgccggttatcgtcattatcagtgtcggtggctttggtgactcgctggaagtgatcaaacaaaagagcatcgaaaacgttgatatgctcaaaggtctgaactttgttgccattatctcactgatgggttgggggctgggttacttcgggcagccgcacattctggcgcgttttatggcggcggattctcaccacagcattgtccatgcgcgtcgtattagtatgacctggatgatcctctgcctggcaggggcggtggctgtcggcttctttgggattgcttactttaacgatcatccggcgttggctggtgcggtaaatcagaacgccgagcgtgtgtttatcgaactggcgcaaattctgtttaacccgtggattgccgggattctgctgtcggcaattctggcggcggtaatgtcaaccttaagttgccagctgctggtgtgctccagtgcgattaccgaagatttgtacaaagcgtttctgcgtaaacatgccagccagaaagagctggtgtgggtagggcgtgtgatggtgctggtggtggcgctggtggcgattgcgctggcggcaaacccggaaaaccgcgtgctgggcttagtgagctacgcgtgggcaggctttggcgcggcgtttggtccagtggtgctgttctcggtgatgtggtcacgcatgacgcgtaacggtgcgctggcggggatgatcatcggtgcgctgacggttatcgtctggaaacagttcggctggctgggactgtacgaaattattccgggctttatcttcggcagtattgggattgtagtgtttagtttgctgggtaaagcgccgtcagcggcgatgcaaaaacgctttgccgaggccgatgcgcactatcattcggctccgccgtcacggttgcaggaaagctaagggacttagcctgcggcggttttgtttggcttcagcagcgggttgcgctcccttaatgtgcctcgccatataaattgaatggtgcagggagcgcgcagggggcggccaatcgccgccgccccctgctgtcccggccttcggggaacgcttcagcgattttgacgccaccaacacccgagctgttattatgttccgggcaaaaagttagatttgataatcgcggatggacgaaattgcttgatacacccgcttatcagttttacatggaagctctgatgcattgagtctggacagttttgtcggctggatacggcgtttacgcggcatccggcaagaacacatggttctttgcaaacaatcccatctttctaccctggaataatcgtttatatcccttggcattacctctctttgtttacattccaacatcattttataaacattccgcttgtgtttttctttgccgtaatgataatcgctatcactgcgatttacttttctttgcatagattgactcagaaaaacgtttaagggtgggtggcatgtttgttccgtttctcattatgttgcgcgaaggacttgaagccgcgctgattgtcagtttgattgccagctatcttaagcgtacccagcgaggccgatggattgtgtgatgtggattggcgtgttgcttgccgctgcgttgtgcctgggcttgggtatcttcattaacgaaaccaccggcgaatttccgcaaaaagaacaggaactgtttgaaggtatcgtggcggtgatcgccgtggtgatccttacctggatggttttctggatgcgcaaagtgtcgcgcaacgtcaaagtgcaactggaacaggcagtcgatagcgcattgcagcgtggaaatcatcatggctgggcgctggtgatgatggtcttttttgccgttgcaagggaagggctggagtcggtctttttcctgctggcggcatttcaacaagatgtcgggatctggccgccgctgggtgcaatgctcggtcttgctactgccgtggtgctaggcttcctgctctactggggcggtattcgcctcaatcttggtgcattttttaaatggaccagcctgtttattctcttcgtcgccgcagggctggcagctggtgccattcgcgcatttcatgaagccggattgtggaaccactttcaggaaatcgccttcgatatgagtgcggtgctctcaactcactcgctgtttggcacgctgatggaagggatttttggctatcaggaagcgccgagcgtcagcgaagtcgccgtctggtttatttatctcatcccggcgctggtggcatttgctctgccaccacgcgcaggggcgacagcgtctcgctccgcgtaacaaatacgacgcaaactcttgcttagttacaacatactttaaagggatagtctcgtcatgaccattaacttccgccgtaacgcattgcagttgagcgtggctgcgctgttttcttctgcttttatggctaacgccgctgatgtgccgcaggtcaaagtgaccgtgacggataagcagtgcgaaccgatgaccattacggttaacgccgggaaaacacagttcattattcagaaccacagccagaaggcgctggagtgggagatcctcaaaggcgtgatggtggtggaagagcgggaaaatatcgcccctggctttagccagaaaatgacggcgaatttacagcctggcgaatacgatatgacctgcggtctgctgactaacccgaaagggaagttgatcgtcaaaggtgaggcaacggcggatgcggcgcaaagtgatgcgctgttaagtcttggtggtgcaattactgcatataaagcgtatgtcatggcggaaaccacgcagctggtgaccgacaccaaagcctttaccgacgcgattaaagcaggcgatatcgaaaaagcgaaagcactgtatgcaccgacgcgccagcactatgagcgtattgaaccgattgctgaactgttctccgatctggatggcagcattgacgcccgtgaagatgattacgagcaaaaagccgccgacccaaaattcactggtttccaccgtctggaaaaagcattgtttggcgacaacaccaccaaagggatggatcagtacgctgagcagctttataccgatgtggtcgatttgcaaaaacgcatcagtgaactggctttcccaccttcaaaagtggtcggcggcgcagccggactgattgaggaagtggcagccagcaaaattagcggtgaagaagatcgctacagccacaccgatctgtgggatttccaggctaacgttgaaggctcgcagaaaattgtcgatttgctgcgtccacaactgcaaaaagccaacccggaactgctggcaaaagtcgatgccaactttaaaaaggtcgataccattctggcgaaataccgtactaaagacggttttgaaacctacgacaaattgaccgatgccgaccggaatgcactgaaaggaccgattactgcgctggcggaagatctggcgcaacttcgcggtgtgctgggactggattaagcgttatgcagtataaagatgaaaacggcgtgaatgaaccgtcacgccgacgtttactgaaagtgataggtgcactggcgctggcgggaagttgtccggtcgctcatgcacaaaaaacgcaaagtgcgccgggtacgctttcaccggatgctcgcaatgagaaacagccgttttatggtgagcatcaggcagggatcctgacgccacaacaggccgcaatgatgctggtggcgtttgatgtgcttgccagcgataaagccgatcttgagcggttgtttcgcttgttgactcagcgttttgcttttctgactcagggcggagcagcaccagaaacgccaaatccgcgcctgccaccactcgattccggcattcttggcggctacattgcgcccgataatctcaccatcacgttatcggtgggtcactcattgtttgatgagcgctttggccttgcgccacagatgccaaaaaagctgcagaagatgacgcgtttccccaacgactcgctggatgcggcgttatgtcatggtgatgtgttgctacagatttgcgccaacacccaggacacggttatccatgcgctgcgcgatatcatcaaacacacgccggatttgctcagtgtgcgctggaagcgggaagggtttatttccgatcacgcggcgcgtagtaaaggcaaagagacgccgattaatttgctgggtttcaaagacggcactgccaatcccgatagccagaatgataagttgatgcaaaaagtggtgtgggtaacggcagatcagcaggagcctgcgtggacaatcggtggcagctatcaggcagtacgcttgattcagtttcgagtggaattttgggacagaacgccgctgaaagaacagcagacgatttttggccgtgataagcaaaccggtgcgccgctgggaatgcagcatgagcatgatgtgcctgattacgccagcgacccggaagggaaggtgatcgcgctggacagccatatccggctggcgaatccccgcacggcggagagtgagtccagcctgatgctgcgtcgtggctacagttattcactgggcgtcaccaactccgggcaactggatatggggttgctgtttgtctgctaccaacacgatctggaaaaaggcttcctgacagtacaaaaaaggctcaatggcgaagcgctggaggaatacgttaaacctatcggcggcggttatttttttgcgctgccgggggtgaaggacgcgaacgattatttcggaagcgcgttattgcgggtttaatgtttttaggcggataaggcatttgtgcgcagatgcctgatgcgacgcttgcgcgtcttatcatgcctacaatcagtgcgggtttggtaggctggataaggcgttcacgccgcatccggcgatcgtgcactgatgcctgatgcaaatcctgctgaaagcacacagcttttttcatcactgtcatcactctgtcatctttccagtagaaactaatgtcactgaaatggtgttttatagttaaatataagtaaatatattgttgcaataaatgcgagatctgttgtacttattaagtagcagcggaagttcccggcagtgatagtcagtcactatggagatcgcggatggtaacgtcctgtactggacatgttttagataatcaacgcgccaccactcgcggagttttctcctccggtagtcatctcgtcactttgcattttcaacctcatcctttcttttcatgtgttaccgacgccgtaaacggtgcgcgtagccgtttttcggcattttatccaaaagcaaactatggcttacaaggaagccaaccctctgatgttcgtgcgcataatcgcgctgccaacggcgcgtgtgatgaatacaaacaactcaaggtgctctccatgggaagacaaaaagcagtgatcaaagctcgtcgcgaggcaaaacgtgtgctgagacgggattcgcgcagccataagcagcgtgaagaagaatcggtcacctcgcttgtgcagatgggcggcgtagaagccattggtatggcccgcgacagtcgcgatacttcgcccatcctcgcgcgaaatgaagcgcaattgcactatctgaaggctattgagagtaagcagctgatattcgccacgggcgaagccgggtgcggaaaaacctggatcagcgcagcaaaagcggcagaggccctgatacataaggatgtcgacaggattatcgtcacccgtccagttctgcaagccgatgaagatcttggcttcttacctggagatatcgcagaaaagtttgctccctattttcgcccggtctacgacgtgctggtccggcgcttaggggcttcctttatgcagtactgcctgcgaccggaaatagggaaggtggaaattgcgccgttcgcctatatgcgtggacgtacctttgaaaatgcagtcgtcattcttgacgaggcgcagaatgtgactgccgcgcaaatgaaaatgtttttaacccgcctcggggagaacgtgacggttatcgtcaacggtgatatcacgcaatgcgatttgcctcgcggcgtgtgctccggattaagtgacgcgctggaacgtttcgaagaagatgaaatggttgggatcgtccggttcggtaaagaggactgcgtacgttcggcactttgccaacgtacgctgcatgcctacagttaagtgtgttatcggtgcagagcccgggcgaaccgggctttgttttgggtgtttatgcccggactagcgctttttctgaaacaaccatttttatttgcccctggctggtgaagtgtacgctcatcctgtggcttttttgtagttgctgatagagctcatcaggtattgctaagctctctgcatattcttgcggcgtatattggtaggctgcatgatgctgctgtttttgaaaacgcagcttattgtacagcgcccagacaattaacacgacggcattcgccactgccagcaaaaaatagaactgaagtcggcttctggcctcgctttgccagtaataacccgtcagcagatccatggcgaataagaatatgaacaacgcaaataatgtccacaagatggttgtggcaacataatcaaccagtaaacgtactggtgattgtcgggtcgtaataattaaattgttcatattaacctctcagaatcccgcgatcgggacttacccaacgggcgcgttgctttttaggcatcaacatgactcgtgtaaatgataccaatgtcgttgccaggctcagcatccagaaaataaccgggaaccaaataatccagaaaagcgatgaagtcagattatgctcatagcgattctcgatcatcaggctgacaataaattgcagtaaacataacgtacacaataatattccggcagtatgtgtcgcagcgatatgtgtcaattcaatatttaacggtacaccggcaagttggactgcgtaaataatgaaaccgaccaggcaggtgaaggcccatattgtcgtcaggcagtattcaaaaaacagcggccacattcgaaagttttctttgcgccacaaccttgtcatatttttgaggaatacttctgcaccgccctgagcccagcgcaggcgctgtttccacagcccttttaacgtttcaggcattaatatccagcacagtgcccgtggctcgtaaaaaatcgtccactgattcaactgcagcttccagctaatatcaatatcttcggtgatcatatcgtcactccagtaacccacttctgccagggcgctgcgacgaaatgcggcaataacaccggaaacggtaaatacgtttccatagatacgctgggttcgcttgatcaaaccaataattgaggaatactcgccaacctgaattttacccaccagggtagaacgtgttcgaatacgaggattaccggttacggcacccacacgcgggttgtacaacatcggttccacaatatatgccgccgcatcgcggtctaataacgcatcgccatcaatgcacaccagatattcacttttcgccgcggcagctccggttttaagcgcaatggctttcccctggttttgcgccagatgaatgacccgcaaatggggaatttgtgcagccatgcgatccaggatggcacgggttttatctgttgaaccgtcatttacggcaataacttcaatgttctcataacgctgtgctaaagcggcgtgtatggtttcctcaacgtttttctcctcattaaaacagggaatgataatggagatagacggattatctttcaactggggagctggtgcgttttctccccacggccagtggcgttcacgatagacccagaaatagacgccgccaacaatccacataatggacataaaaaacggccagaagaaaacgaacctcatcatcagttcaccagagtgaaagtacgctacgcataggggtatgcataacaccagacataatataaaaaacgatacgatgcgattaatcatttttcggataccaggctgttgaaaactcaggacgaataaggtctatttcaggttggttatgcagaaaattgtcgggataataaccatagtttttcactccattcagttgtaataggctcatccagtgagcgagttgttgcgaagaaatagcctgatgctgaccatttttctgccagttttgtgcctgtaattctaaaatagatttgtctttagcctgagggatgtttttaatttgattggtcaattgtattaaccattggtcagccgatttttctgcgacaccttccagataaggcatagccataatagcggtccagtcatagctttttaggaaatcagcataattctgtgcaaaccaggcttcactttcaggttgtattaccggaagtgcaaaaatatttcgtgcagttttaatatgtggaccgcgaatggcttttacgcgcgcactaagttctaaagtgaagtcagttaacgcacgacttttaaagcgggcccactgtttaaattgctccgggttttgtcgaatttcgctcagactcccgctaaagcctgcttgctgataagccgtgatagccggtgcactggcatcttcataatctgaaagcaaagcatcatcgtggaacaatatgccatcaaaagcagcatgtccggcaagatcttcatataacatgccaacttgtgctctgactctgtcatcgaaaggagagagacggtgatattgttcaggatgaatttgtgcttttttctcccctgttggtaagtattttactcgcgttaatgtgggatctaaatcccagcttaataccggcatccacgcatagatgtttacacctgagcgggtacgtaattgccaggcaacccgactaaaaatatctgctttcattggtagcaaacgatttggaaaccagacctctttgaccagcccatcaccatcgggatcagcaaatgcctgcaaatacacggttgatatttgcatatctttcacccgctgaattagcacatcaatattgcgatccatttgctggaggttttcgtcataaacgtaatcaagatcgatatgcattatccgttgtggtgatttttcctgtacggtaataatttgctgggcaaactcttttaatgagggattattggcgattaatacccgcggaatggaatccaattgcgacgcatttgccaaacctgattcaagggtgaagaacatgtcataaccgagtttttttaattcctctatcgctatgccattcgcttcgccataaggccaaacaaaaacgtgtggatttacctcaacctttgtacgcaggtattccgtcatttttacagcatccagacgaattctttcccggtattctgctgcggtttcataccgtgcgtggtcagtaaaatatgcacgatttacatatacaggcaataagctgccggtggcattagcctgaataccgtagtgagaattccatgtatgagaagcgagctcaacgagccgggaacgcgcaacttctcgcacttgttgccacgtggcaaaatattctcgatcgaccaactcatcgccaaattttacttgtttatccgctggcgtatcgacccaactgccgacgggggcccatacagcaggccactggaaggcctgaagaattgggaagacgcgggtataaaaactctggtagccgtcatcaaaagtcagcactacagctttttccggtagcggttttcctcctcgatgtgcttcacgaatttgagcaatactgaccggttgataaccgttctcgcgcagccaggcaaattgttcacgcagtgctgatgtccgcactgacataaaacgctggtcggcagcttcgtcttcaacgttatgccatgaaatcgctacaaaaccattatgcggccacggttgctcggcgagtaaagattcgcgatcctgtggcggtataaatgatgttcttgactggctaatgcacgcggtgagcataattatactcaccagcatcaggagatatttatttccattacgtaacatatttatccttaaaatctgaatgtcatatcgaattcaacgtataagttgtgttctctgtcaccgtcataaggtcgtttttcccagcgtagcgttgcgccagcatcaatcacgtcattccaactaatgcgttgcccgtagccgagttgggtgacgacatccgtgccataatgtttttgccaggaggcaccaacacctgcgctgaatatttgctcccagctattttcatagcttcgccataacaaatggcttgcctcaaatgccggaacaatatcgaacgtttttatagggttgtagtatggggtatcgtgttctgtattttgttcgtaatacagactgggtaggaaatcgacaatcaaatatggtgaagaccagatgcgttcctgaccctcaagtgagacttcatgacgctggttactgtcggaaaaatcagtgaaagcccaggagacaccgtacttacgccgctcattttgataccagcgaacataagcctgagcactgttgcctgtaacaccatttttcattgcccgtaatggaacgcggtgagagaggcgttccagttgcgaaccaatacgccagttatcattaaaatcataccagccagacaggcgcgcgccgggtttatgctcatgattgaaaacgcgttcagcgtactctgcctcgagccagatattacgtgaccgccactcaacacccgcaagccagtcgcgaacaatcccttttccttcgctaaattgtccatcggcataaccgaatccagcaaaaccgcgccagttatccttcagcggtggtgaataaacgatggtggttaagtcgacatcatgtttaccactatccgggccttcggcatcaattcctgttgagccagcgatacgaagctctgcaagattatgtacatcaaccgcacgttttaatcgtacaacgccgggatcttgcggttcacgttcgacaacatcgtgcgttaagacagctgcctgctgccattcttgtaacgttaatgctgtccaggcttgttcaacctccagattaatattacgtggctcgatcacttctgctttttttaattcattttctgctgcacgaggccaaccgcgggcttgtaacacactcgcgtaatcaatgcgcagtccctgatttcctggtgcgttataagcaagctctctggctgtcatttcagcctgaggaagatcattactatattttgctacggttgagagaaacgaatgcccctgtaaccaggtatcattcgggatgctcgtaggcgtgcccattaaccgaaggaaaggcggcgaagtattaatggtatgttgggtgacagttagcgcgcccggataattttcactctccaggtggctgtaaaagagatccgcaagttcttcatcggataaatccggggcaatggtctccttgtgataaaagagctcggtcattattgactgtgcttttttcggctgatgatctttgagataagccgatgcaacccaatattgcccccagggcggaataatttgccccgtcttttttaatcgctgatagtgagaaataacgtctttataacgatcgcgagttaataacgcgccaagatgatcaacctgaatacgctggtactgggcagtgcggtctgggttatcgtgccacagaatttctaatgcagcgtattgggcgagggcgcgatcggcaatggcataacgttcactttcactgcgcgtaggcataaacgacagtctgaccagttcggcatgaatatcagcgcgaatatctggcgttaaattggcatcgtcaatcgcggcagcaagttgattattacgtaatgcctgcacgtattctgtgggatattgttgcgtagatgcattttcaggtaatgactctgtcatcgcccgtaattcatcctgatgacgccccgccagtttatagatataggcttctgcgagtaaattggctttgtccggtgctccagagttaagctgcttaagtttaaccagcgcagtatcatagtgaccagcatctgccagggttaaaatttgtccccgttgataatccttattttgcggctccagagagagcgccttttgccacagtgtaagcgagttttgccattgttgcaggttacgataagcgacggcgacagctgcataaccacgcgctggtaattgctgatgacggtagcggttgtaaacggtaataacctgtttatcttgcccggcccataaggcaatctgtaaccagtcagcaatttggttattgctgagtgctgattttagtgcaaaccatgacaaagctggctgagtattacccttgcgagcttcaataatcaatgcatcataggcgttattaacagcactcttcgccgcgggactcgctgctaaaaatgcggcagtaagaagtttcaaagcccatttggttttcgggcacctttttctgctacttgaatacatcctgtattactccatgtattgccaaaatctctctctgtatctaattacaggtaactgaaaagaaagatatttttgcacctcataatccgttattaaacgcggaagagagacgtgaattgttgatgatgagaagaagaaatgatgagcagagtgtccatataaaatccttttctcgcccgaaaatccattccaatgatgaggatcttcaggaatacggcataaatcccaatgcctttttcaaaataaattaggattaaaataattaaatcagtaaattccgatgcatgatttcggatttttcgaaagtcctgatgaaaggctgcgctacggcactcacggatttaattgttattcctaatgtatctatgaattaatgttttataaggattttctataaccatttataagtattttcaagcctggcttgttgcaaacaatgtataaagcacttaggcaataataattacattcagcaactatcatcatcggtattgtttgtgggcggaatttcatattgacaacagtacagttcttatatctattaataatagaaagggatctacaacctacagattggtgtagctttatggaaaaagactatttgagaattagtagtactgtattagtgagcttattgtttgggcttgctttggttttggtgaatagttggtttaatcagccaggcgttgaggaagttgttccacgatcaacctatctgatggtaatgattgctttattttttatcgatactgttgcatttatttttatgcagttgtatttcatttatgaccgtaggcaattttcaaactgtgtacttagtttggcttttctgagttgtttgatttactttgttataaccgtcattatcattcagcaaattattgaggagcgtttgacaagcagtgttgtccaaaatgacattgcaatctattatttgtttcgtcagatgagtttgtgcatattaatatttctggcattggtgaataaagttagtgaaaacacaaaacagcgcaatttattttccaaaaaaatgactttgtgcataagtttgttttttgtttttggggggccgatagttgctcacatactttctagtcattatgagagctacaatttacacattgccgagttaaccaatgaaaatggtcaggtggtttggaaagcctcatatgttaccataatgattttcatgtggttaaccttgctttcggttaatctatactttaatggtttacgctatgatatctggaatggagtgacggtgattgctttttgtgccgtactgtacaatatctctctgttatttatgagcaggtatagcgtgtccacttggtatattagtcgcactattgaagtagtcagtaagttaaccgttatggtaatatttatgtgccatatattcagtgcgctacgagtaacaaagaacattgcacatcgcgatcccttaaccaatatatttaacagaaattatttttttaatgaactgacagttcaatcagcatcagcccaaaaaacgccttattgcgtcatgattatggatatcgaccacttcaaaaaagtcaacgacacctgggggcatccggttggcgatcaggtgataaaaacagtggtgaatatcattgggaaaagcatacgaccagatgaccttttagcgcgcgtcggcggcgaagagtttggcgtcttgctgacggacatcgatactgaacgtgcgaaagctttagcggaaaggattcgggaaaatgttgagcgtttaactggcgataatcctgaatacgctataccacaaaaagtgacgattagtattggcgctgttgtgactcaggaaaatgcgttaaacccaaatgagatctatcgactggctgataacgcactttacgaggcgaaagagaccgggcgtaataaggtggttgtgagggatgtggtgaatttttgtgagtcaccataaagcggcattttgatcctacccacgtaatatggacacaggcctaagcgaggttcttgttttcaaattgttccggactgaggccgccacaccaactgtgccgccgccaccgattgtaatcacattcgatataattaaacaccgttgcccgcattatttcccggctgataaagtgttctccatggatacattccactttcagcgaatgaaagaagctttccacgcaggcattatcgtagcagcaaccttttgcgctcatacttccacgcagattatgccgcttcagttgcgcctgataatctgctgaacagtactggcctccacggtccgtgtgaacgataacgttccggggcctcttacgccgccacagcgccatctgcagggcatcgcaggccagttgcgccgtcatgcgtggcgacattgaccagccaataacggcacgtgaccacaggtcaatgaccactgccagatacagccagccttcatctgtacgtaagtacgtgatgtctcctgcccacttctggttcgggccactggcgtaaaaatcctgctccaacagattttctgacacaggcaggccgtgtgcgcggtagctgaccgggctgaacttccgggaggcctttgccctcagtccctgacggcgcaggcttgccgccacggtttttacgttaaaggggtaaccctgagcacgcagttcatccgtcaggcgtggggcaccgtaacgctgttttgaccgggtaaaagccgcgaggacaacgctgtcgcagtgttggcggaactgctgacgcgtgcttatccttgtccgccgctgacaccacgtataccagccgctgcgggccacccggagcacgcggcacattgctttgatgctgaactcagcctgatgtttttcaataaagacatacttcatttcaggcgcttcgcgaagtatgtcgcggccttttggaggatagccagctcttcatcccgttctgccagctggcgtttgagacgtgcaatctcggtagacatctccagttcacgttcagaagacgtctgctgattttgctgtttactgcgccagttgtagagttgtgattcatacaggctgagttcacgggctgcggcagtaacaccgatgcgttcagcaagcttcagggcttcactgcgaaattcaggcgaatgctgtttacggggttttttactggttgatactgtttttgtcatgtgagtcacctctgactgagagtttactcacttagccgcgtgtccactattgctgggtaagatcagtgcctggcacacgcgtttgatggaagacggcgttcaggcaatgcgcgattatcttgccggactggatatcgcttcgccagagcatcaggttctgatgaacgtaacagcaaaaagcgaggtcgctccgtcaattatcaaagaaaatctctcattacacttaactcatacggtgaaatggactgaatctctcgatacatttctgaatatgccaaccccggtagctttccttgaaataagtaataagccctatttggggaatatgttaaatgattttgctggcgtggatcagcaacgagttatgcattgtcgtaaagcatttagtgatgcaaaggtattcaaatgattcctgattatttaacttttattcgctttcaggataaacgaaatctgatatacatttatgctattggacttattctgataggcttttattggaagaatgcagggtttacttttccatcagaggatattggtgtagttagtgggattctggctctggtgctgtataattttatttttgatctcaaggcgtactgggcttataaatgcgtcacgaagaatatcgatttttcgtggtttaagaaaaagcagaaccacaaaatagaattatttcttacacaacctctggtggcaggatttctgtcgttaatcatgttgagtgcaatgagttgggggctataccagcttctaccctcgttatatgcgctgttcctgatttcgttacttgggccgttggtcatctttctgctgtttcggatgatccgcaccagttatgtcaagcaggtcgctatttcagtagcgaaaaaagtaaaatataaaagtctgactcgctatgtgctgctttcggtgtgcatctcaacggttgttaacctgcttactatcagcccgttgcgtaacagtgattcttttgtgacagaggggcagtggttaacgtttaaatcgataattgcattgctcattctttgtggcgtagtgttggcgattaatctgttttttctgcgcttctccaagcggtacgcttttctgggcaggctttttttgcaggaaatcgatctgtttttctccagtgaaaatgcgttgtcgaccttttttgccaagccgctttggcttcggttattcatattgctggttattgaagtgatgtggattacgctggtgtcggtattggcaacgcttgtagaatggcggatttggtttgaagcctattttttactctgctatgtaccgtgcttaatttactattttttctattgtcgattcctctggcataacgattttatgatggcatgtgacatgtatttccgttgggggcattttaataagtgaggaagtgataggaagtgaccagataatacatatatgttctgtactctcttgcgcattttgattgttgactgagtaaccagacagttgatgtgcacgatttcccctcgccctaacagacgtgggcgggggcacccggtgtgtgcaatatacgaaaaaaaagcccgtactttcgtacgagctcttctttaaatatggcggtgagggggggattgactcgcttcgctcgccctgcgggcagcccgctcactgcgttcacggtctgtccaactggctgtcgccagttgtcgacccccggtcggggcttctcatccccccggtgtgtgcaatacacgaaaaaaaagcccgtactttcgtacgagctcttctttaaatatggcggtgagggggggattgactcgcttcgctcgccctgcgggcagcccgctcactgcgttcacggtctgtccaactggctgtcgccagttgtcgaaccccggtcggggcttctcatccccccggtgtgtgcaatatacgaaaaaaaagcccgtactttcgtacgagctcttctttaaatatggcggtgagggggggattgactcgcttcgctcgccctgcgggcagcccgctcactgcgttcacggtctgtccaactggctgtcgccagttgtcgaaccccggtcggggcttctcatccccccggtgtgtgcaatatacgaaaaaaaagcccgtactttcgtacgagctcttctttaaatatggcggtgagggggggattcgaacccccgatacgttgccgtatacacactttccaggcgtgctccttcagccactcggacacctcaccaaattgtcgttcctgtcttgctggaacgggcgctaatttagggaaatcatgacctgaggtcaacaaactttttgaaaaaatcgcgcgtttattcaaacttcaatcaatgtgtggttttaataagcgaaatctgctttttttgccaccgaccacggatttgttatgctggtggcctttgtagatcataacgataagtgcgaataaatttcgcacaacgcttttcgggagtcagtatggatatcatcttttatcacccaacgttcgatacccaatggtggattgaggcactgcgcaaagctattcctcaggcaagagtcagagcatggaaaagcggagataatgactctgctgattatgctttagtctggcatcctcctgttgaaatgctggcagggcgcgatcttaaagcggtgttcgcactcggggccggtgttgattctattttgagcaagctacaggcacaccctgaaatgctgaacccttctgttccactttttcgcctggaagataccggtatgggcgagcaaatgcaggaatatgctgtcagtcaggtgctgcattggtttcgacgttttgacgattatcgcatccagcaaaatagttcgcattggcaaccgctgcctgaatatcatcgggaagattttaccatcggcattttgggcgcaggcgtactgggcagtaaagttgctcagagtctgcaaacctggcgctttccgctgcgttgctggagtcgaacccgtaaatcgtggcctggcgtgcaaagctttgccggacgggaagaactgtctgcatttctgagccaatgtcgggtattgattaatttgttaccgaatacccctgaaaccgtcggcattattaatcaacaattactcgaaaaattaccggatggcgcgtatctcctcaacctggcgcgtggtgttcatgttgtggaagatgacctgctcgcggcgctggatagcggcaaagttaaaggcgcaatgttggatgtttttaatcgtgaacccttaccgcctgaaagtccgctctggcaacatccacgcgtgacgataacaccacatgtcgccgcgattacccgtcccgctgaagctgtggagtacatttctcgcaccattgcccagctcgaaaaaggggagagggtctgcgggcaagtcgaccgcgcacgcggctactaataaagcatcaggattcctgctatccttggcgggaattgaatacaggagagagttatgtatcccgtcgaccttcatatgcataccgttgccagcacacatgcatatagcacattaagtgattacattgcccaggccaaacaaaagggcattaaactttttgcgatcaccgatcatggcccggatatggaagatgcgccgcatcactggcacttcattaacatgcgtatctggccgcgagtggttgatggggtagggatcctgcgcggcatcgaagctaacattaaaaatgttgatggtgaaattgactgcagcggtaaaatgtttgactcgctggatctaattattgccggttttcatgagccggtttttgcgccacatgacaaagcgaccaatacacaagcgatgatcgccactatcgccagcggcaatgtgcatataataagccatcccggaaatcccaaatatgaaatagatgtgaaagccgttgctgaagcagccgcgaaacatcaggtggcgctggaaatcaataattcctcatttttacactcacgtaagggcagtgaagacaactgtcgtgaggtagccgcagcggtacgtgatgctggaggttgggtggcattaggctcggattctcacaccgcgtttaccatgggggaatttgaagagtgtcttaaaatcctcgacgcggtagattttccgccagagcgcattttgaatgtttctccgcgccgcttactgaacttccttgaatctcgcggtatggcaccgattgcggaatttgcagacctttaattactagtaatggaaatatattaatgaacgagttttctatcctctgtcgtgtgctgggttcgctctattaccgccaaccacaagatcctttactggtgccgctgtttaccctgattcgtgaggggaaactggctgcgaactggccactggagcaggatgagttgctgacacgtttgcagaaaagctgtgatatgacgcaagtctctgccgattacaatgcgttgtttatcggcgatgaatgtgctgtgccgccatatcgtagcgcatgggttgagggcgcgacggaagcggaagtgcgcgcttttctttctgagcgagggatgccattagcggatacgccagccgatcacatcggcacattgctgctcgcagcttcctggctggaagatcagtcaacggaagatgagagcgaagcactggaaacactgttcagtgagtatctgttaccctggtgtggtgcgttccttggcaaagtggaggcccatgcaaccacgcctttctggcgcaccatggcaccgctaacccgcgatgccattagtgcaatgtgggacgagctggaagaagattctgaagaataagtgtgatctacgtcactcataactgcaacggataatttgttgttgcataaaatgtgtgctcgatctcattcatggccgcgttttctgctatcatgcgcggcatgaacatacttctctctattgcaatcacaacaggcattctctccggtatctggggatgggtggctgtttccctgggcttactaagctgggcgggcttcctgggctgtacggcctactttgcctgcccgcaaggtgggctgaaagggctggcgatctccgctgcaaccctgcttagtggcgtggtgtgggcgatggtcattatttacggtagtgcactggcaccacatctggaaattctcggttatgtcataaccggtattgtcgcgtttctgatgtgtattcaggccaaacagctgctgctttcatttgttccggggacgtttataggcgcatgcgcgacgtttgccgggcagggtgactggaaactggtgttaccttcgctggcgcttgggctgatatttggttacgcaatgaaaaacagtggcctgtggctggcggcgcgtagtgcaaagacggcgcaccgtgagcaggaaatcaaaaataaagcgtgaggggcactcacgctttcgcttaaacagtaaaatgccggatgataattccggcttttttatctgtcaggattccggtggaaccgacatatggcggtatttcaccagaatgtcattctgccgttctgctttattttgcaaatcccacagaccacggtcgataccatcattaatcaggaaaatgacccctgtttcgatagccgacatcaggcacagcataacaggttcgttcgaggtgtaacccacttccccttcaagcaagcgctggtagtcaataaagcggaaaaccccggcctgaacttcataggaaagtatcgtcttactggtgttcaccgaagaaaggatctcgccggtactcacattgacgacgcgcaggttcacggcaatctgatcgagctggtattgcgtgtcggcaccgatgccaaaatatcttgccccaaccccgccagatttgacgttgctttcataaccgataatcgaaccttcaaccatgatatttgccgccgttaaagattgcagcgggattcggttattaatggcaaccgtgccgttttcttgtgccgcacgaataatcttgcgctcgttaagcaggttttgtaagccctggcgctccagcggtataaaccagcgagaatctttcagtgccgtgaccagcattgccgtggcgctttgcggaacagcagtggagaagttacttgccgggtagggtttaaattgcccggtttcgtcctgaatgttgtataccgaaacaaagattttacccgtcggcgctggcagatgggtcaaatctttgtagctctgagcacgaggcattaatgtcggtctggcggcttctttaggcggggcggttaagcatccgctcagtaacatgacggcaaccaaaagaaataagcgctgcatgattattttccttatgaagctggggcttaaaaatcggttgagttattttgtaaacccgaaacctggatggtcgaggtttgtccggttttacgatctgtcacgttcaactgcaattgaccatcgcggttggcaatatcgacaatataatcgttggtcaccatgcggcccggtttaccggtattaatattcgacagtagcccacctaaaatttgtgactggatggcctgagtaaagttatctaacgctgagggtgtttcaataccaaagtcatcgttatagctcggatctttataagagttttgggcctgagcgctatttaataaaaaagcgccattatttgggttaccaccaaagtttggattacggaactggaaagtcatggttccagcccaacttaatggcgaaataagcatgagtagaactactgcatgtttgacacgcattgcagcctccgaacaattttttatttagaattcatcatgcgccaaatcgcccgtacttaataacgcctgatttatctggcgacgatttagtgcttcttcagtttgaatcagtgcaaagacgacagttttctcgaagtctcttttcaacggaaataaaaaagtctggaaaataacgtcctgattgaccgttatagtgatccagcttccccatcgtgcactgggcctttcattaatcgttaagttacccgtatagtcactttcccatttatcactaaaggctcggtaaaaatcatggccaatagatgaaacagtatggtcagttagcaatcccgggacttctacctcaacggcgtgaagattccctgcggcgaacagaaattctgccgccacaatccagcgtaaataacgtttcatggctttatcgcctgaggttatcgtttgcccaggaaaccgcttgtgtccggttttttacggctatcttcttgaaaagattataaagatgcgttttaaccgtattttcgctgatgaacaacgaacgagcgatctcgttattagacgcgccgatacgcagcttattcaggatctctttttcccgatgagtaaggagggctgattccgtgctgttataacgatagttacctgaatgcgtaatcaggtagctggcaagcttttgcgtaaagtagcattcgccgcgcaggacgccttgcaacccattgacaacacgttcttgatcctccatggaataaaaaacgccgttgatatgaggccagttttcaatgtcgcggtacgggtaatcttcaggcgtatttagcaacaatattttgatattgttgtttttcctgctcaaagtatcctgccaataatggataagctttttatccgcttccatcatatccagaagaataatagagcctgaagagatatcgtccagagaacgttgaatattatgtaattttcctgtaattgccagcgattgtttaaggtgctgcaagagagctgtcgcctgcaaagaagatttagtgatcaacaataatgtatgaccatgaatactatggacttcattaaacatgatgaaaccccgctttttttattgatcgcacacctgacagctgcctctaaaatagaagcaccagaagtactgacagatgttgcactgctgtgtgtagtaataaatcagccctaaatgggtaaaatataaaactaatggattacatctgatttcaatctagccattacaaatcttaaatcaagtgttaaacatgtaactaaatgtaactcgttatattaaaatgttaaccttaaggttttattaagtttagaaatgatagaaaagttgtacatttggtttttattgcacaattttaaaaaatcatacaaatggtgataacttactaataatgcatataaaaaatatttcggtgtagtcctttcgtcatgtaaaacgttcttgttttttctccacacctccgtggacaattttttactgcaaaaagacgaggtttgtcacggcttgtgcgcaagacatatcgcagcaatcagcgacgggcaagaagaatgactgtctggtgctttttgatagcggaaaacggagatttaaaagaaaacaaaatatttttttgcgtagataacagcgtatttacgtgggttttaatactttggtatgaactaaaaaagaaaaatacaacgcgcgggtgagttattaaaaatatttccgcagacatactttccatcgtaacgcagcgttaacaaaatacaggttgcgttaacaaccaagttgaaatgatttaatttcttaaatgtacgaccaggtccagggtgacaacatgaaaaacaaattgttatttatgatgttaacaatactgggtgcgcctgggattgcagccgcagcaggttatgatttagctaattcagaatataacttcgcggtaaatgaattgagtaagtcttcatttaatcaggcagccataattggtcaagctgggactaataatagtgctcagttacggcagggaggctcaaaacttttggcggttgttgcgcaagaaggtagtagcaaccgggcaaagattgaccagacaggagattataaccttgcatatattgatcaggcgggcagtgccaacgatgccagtatttcgcaaggtgcttatggtaatactgcgatgattatccagaaaggttctggtaataaagcaaatattacacagtatggtactcaaaaaacggcaattgtagtgcagagacagtcgcaaatggctattcgcgtgacacaacgttaatttccattcgacttttaaatcaatccgatgggggttttacatgaaacttttaaaagtagcagcaattgcagcaatcgtattctccggtagcgctctggcaggtgttgttcctcagtacggcggcggcggtaaccacggtggtggcggtaataatagcggcccaaattctgagctgaacatttaccagtacggtggcggtaactctgcacttgctctgcaaactgatgcccgtaactctgacttgactattacccagcatggcggcggtaatggtgcagatgttggtcagggctcagatgacagctcaatcgatctgacccaacgtggcttcggtaacagcgctactcttgatcagtggaacggcaaaaattctgaaatgacggttaaacagttcggtggtggcaacggtgctgcagttgaccagactgcatctaactcctccgtcaacgtgactcaggttggctttggtaacaacgcgaccgctcatcagtactaatacatcatttgtattacagaaacagggcgcaagccctgttttttttcgggagaagaatatgaatacgttattactccttgcggcactttccagtcagataacctttaatacgacccagcaaggggatgtgtataccattattcctgaagtcactcttactcaatcttgtctgtgcagagtacaaatattgtccctgcgcgaaggcagttcagggcaaagtcagacgaagcaagaaaagaccctttcattgcctgctaatcaacccattgctttgacgaagttgagtttaaatatttccccggacgatcgggtgaaaatagttgttactgtttctgatggacagtcacttcatttatcacaacaatggccgccctcttcagaaaagtcttaatttgttgaaatatcgagcataagatgaatctggagagaatggtctgctgcgaatcagccaacctgaaagtatggataacacaaccctcaaggatgactaatcattgaggaaatagaataaatgttcagaccttttttaaactctcttatgctcggcagtttgttttttccttttattgccattgctggaagcaccgtgcaagggggcgtgatccatttttatggccaaattgtggaaccggcatgtgacgtcagcacccagtcatcacccgtagaaatgaactgcccacagaatggttctattccgggcaaaacctactccagcaaagcgttaatgagcggcaatgtcaaaaacgcgcaaatagcctcagtaaaagtgcagtatcttgataaacagaaaaagctggctgtaatgaacatcgaatataactaagtttctgaacaactcacgttgctgagcagaaaaatgcgatttaaccaaaaagcctgctgtacacttaagaaacaagaaggtgtaaggaggcgttatgaaaacgcgtattcatgttgtgcagggtgatattaccaaactggccgttgatgtgattgtgaatgcggctaatccgtcattaatgggaggcggcggcgtcgatggggccattcatcgcgcagcgggtccggccctgctggatgcttgtttaaaagtcaggcaacagcagggcgattgccctacggggcatgccgttattacgcttgcaggcgatcttcccgctaaagccgtagtgcacaccgtcgggccagtctggcgtggtggtgaacaaaacgaagaccagcttttgcaggatgcctatctcaatagcctacgactggtggcggcaaacagctatacgtcagtggcttttcctgcaatcagtactggggtttatggttaccctcgtgcggcagcggctgaaatcgcagtaaaaaccgtttcagaatttattacccgtcacgctttacccgaacaggtatactttgtctgttatgatgaagaaaacgcccacctctacgaaagactccttacccaacaaggagatgaatgatttgccccggctggcgagcgcggtgctgccactgtgttcgcaacatcccggtcagtgtggcctttttcctctggagaaaagtctggatgcgtttgccgcccggtatcgtctggccgaaatggcagagcatacgctcgatgttcagtattacatctggcaggacgatatgtcgggtcggttactgttttccgccctgttagccgcagcaaagcgtggcgttcgcgtccgtttgttgctggacgacaacaatacgcccggacttgacgacattttacgcttgcttgacagtcatccacgcattgaagtccggctttttaatcctttctcgtttcgcttgctgcgtccgcttggttatatcaccgacttttcccgtcttaatcgccgtatgcacaataaaagtttcactgtcgatggcgtggtgaccctggtgggaggacgaaatattggtgatgcctattttggagcaggggaggagccacttttttcggatttagatgtcatggcaataggacccgtggtagaggacgttgccgatgatttcgcccgctactggtattgcaaatcggtttcacccttacagcaggtgctggatgtcccggagggtgaaatggcggatcgcatcgagttacccgcctcctggcataacgatgccatgacgcatcgttatttacgcaaaatggaatccagtccatttataaatcatctggttgatggaacattgccgcttatctgggcgaagacacgtttattaagtgatgatccggcgaaaggggagggcaaggcaaaacggcattcactgttaccgcagcgcctgttcgatatcatgggctcacccagtgaacgcatcgatattatctcttcctattttgtaccgacacgcgcaggtgtggcgcaactcttacggatggtgagaaaaggggtaaagattgcgatcctaaccaattctcttgccgctaacgatgttgctgtcgtccatgccggatacgcgcgctggcgcaaaaaattgctccgctatggcgtggaattatatgaactcaagccgacgcgtgaacaaagtagtacgttacacgatcgcggcataaccggtaattccggagccagcctgcatgctaaaacctttagcatcgatggtaaaacggtgtttatcggctctttcaatttcgatccgcgttcaacattgctcaatactgaaatgggcttcgtgatagagagcgaaacgctggcacagttaattgataaacgctttattcagagccagtatgatgcggcctggcagctccgtctggacaggtggggacggatcaactgggttgatcgtcatgcaaagaaagagattattctcaaaaaagaacccgccaccagtttctggaagcgggttatggtcagactggcgtcgatattgcccgtggaatggttattgtaaatgtggcttaacgggctggtgctttatcgttctcacgcttaacaaccggtttaccagagaacaaaaacttcagtaacgggatgcgcaaatgaatttcatacagaattatcgcaatccctactacaaatatcaggccacagagaaaaccaagccagttggaggtgatgtgcggtgtaatgtatgcgccgaaaaacagcgttaacgggtggtgaaccagatagataaacagcgatgcgttaacaaaataagtcacccgcgctgactggaagttaagcaaacggtggccaaaggagaagaccacattcaccatccacagaccgaggaccatggtgatcaccgactcggtttcgtacatccaggcatcgccactgccatagcgctggttgagtaaataagcgacaaacgccaatgctgctgcaagggtacagccacgagacggcgtggtaaacaaggctttaagatgagggaaaatgaaagccagtgcgccgaggataaagaacggcaaataaaacagcgtttgcatgacaataaaattgaacatgccattactcagaatgggcggatacacaataaaaatcgttcttcttattaccgcataaccgatgccgaggcataaaaaaatcaccgatagttttaccatcgagaattttttattcgttttatcagaattttctaaattatttctgatgcgcttaaatatccatacgcacagcgtcgtcatgaccactaacaccagtaaaaaccacaggtgtgatattaattcccaggccaacgtattatatttgtcatacaatgacagcccaggccaactttccgcttttcctttgacatattgcagcataataaattgcggtaatgtcagtagggggatggctgttaacatcgggatacctacacgttcgacacgtactttccaccattttttcaagggatagcgtaaaaaaagcatgtaggaaaagtagccggatataacgaaaaatacctgcatgcggaacgagtggatgaagtcattaaaaagggtcagccacaatgatgattcggcgctattcacatgccatgtatggctcgaatagattaaagaaatatgaaaaggtatccctaacaacatcagccaggcgcggatggagtcgaggaaatattcacgttgcgcgggtactgggttcatatatggttaactaatctcggatttttcgtcttatccctgtcgggttatgcctttaggcttgttgccatagtgacaccgacctgaccgcgccaggcgcaggcttcaaggtttttatgcatagcatcatcgctaccactaaccagaatggaagcgtctgtaagacggttgataaataaatttgctggcaaaccctacacgaagtcgatgcttctgtctttaggagaagcacggaaagtgaaaacggttgcaatcaggtgcttaatccatgagccagcgtgctgaacgataccgggattctgttgtcggaatggctggttatccattaaaatagatcggatcgatataagcacacaaagggggaagtgcttactaattatgaaacataaactacaaatgatgaaaatgcgttggttgagtgctgcagtaatgttaaccctgtatacatcttcaagctgggctttcagtattgatgatgtcgcaaagcaagctcaatctttagccgggaaaggctacgagacgcccaaaagcaacttgccctccgttttccgcgatatgaaatacgcggactatcagcagatccagtttaatcatgacaaagcgtactggaacaatctgaagaccccattcaaactcgagttctaccatcagggtatgtacttcgataccccggtcaaaataaatgaagtgactgccaccgcagtcaaacgaatcaaatacagcccggattatttcactttcggcgatgttcagcatgacaaagatacggtaaaagaccttggctttgccggttttaaagtgctttacccgatcaacagcaaagataaaaacgatgaaatcgtcagcatgctcggggccagctatttccgcgtgattggtgcaggtcaggtttatggcctttctgcccgcggcctggcaattgataccgccttgccatcgggtgaagaatttccgcgcttcaaagagttctggatcgagcgtccaaaaccgactgataaacgtttaaccatctatgcattgcttgactcgccgcgtgcgacaggtgcttacaaattcgtggttatgccagggcgtgacacggttgtggatgtgcagtcgaaaatctatctgcgcgataaagtcggcaaactgggggttgcaccgttaaccagtatgttcctgtttgggccgaaccaaccgtcgcctgcaaataactatcgtccggagttgcacgactctaacggtctctctatccatgccggtaatggcgaatggatctggcgtccgttgaataacccgaaacatttagcggtcagcagcttctccatggaaaacccgcaaggctttggtctgttgcagcgcggtcgtgatttctcccgctttgaagatctcgatgatcgttacgatctccgtccaagcgcatgggtgactccgaaaggggagtggggtaaaggcagcgttgagctggtggaaattccaaccaacgatgaaaccaacgataacatcgtcgcttactggacgccggatcagctgccggagccgggtaaagagatgaactttaaatacaccatcaccttcagccgtgatgaagacaaactgcatgcgccagataacgcatgggtgcaacaaacgcgtcgttcaacgggggatgtgaagcagtcgaacctgattcgccagcctgacggtactatcgcctttgtggtcgattttaccggcgcagagatgaaaaaactgccagaggataccccggtcacagcgcaaaccagcattggtgataatggtgagatagttgaaagcacggtgcgctataacccggttaccaaaggctggcgtctggtgatgcgtgtgaaagtgaaagatgccaagaaaaccactgaaatgcgtgctgcgctggtgaatgccgatcagacgttgagtgaaacctggagctaccagttacctgccaatgaataagacaactgagtacattgacgcaatgcccatcgccgcaagcgagaaagcggcattgccgaagactgatatccgcgccgttcatcaggcgctggatgccgaacaccgcacctgggcgcgggaggatgattccccgcaaggctcggtaaaggcgcgtctggaacaagcctggccagattcacttgctgatggacagttaattaaagacgacgaagggcgcgatcagctgaaggcgatgccagaagcaaaacgctcctcgatgtttcccgacccgtggcgtaccaacccggtaggccgtttctgggatcgcctgcgtggacgcgatgtcacgccgcgctatctggctcgtttgaccaaagaagagcaggagagcgagcaaaagtggcgtaccgtcggtaccatccgccgttacattctgttgatcctgacgctcgcgcaaactgtcgtcgcgacctggtatatgaagaccattcttccttatcagggttgggcgctgattaatcctatggatatggttggtcaggatttgtgggtttcctttatgcagcttctgccttatatgctgcaaaccggtatcctgatcctctttgcggtactgttctgttgggtgtccgccggattctggacggcgttaatgggcttcctgcaactgcttattggtcgcgataaatacagtatatctgcgtcaacagttggcgatgaaccattaaacccggagcatcgcacggcgttgatcatgcctatctgtaacgaagacgtgaaccgtgtttttgctggcctgcgtgcaacgtgggaatcagtaaaagccaccgggaatgccaaacactttgatgtctacattcttagtgacagttataacccggatatctgcgtcgcagagcaaaaagcctggatggagcttatcgctgaagtcggtggcgaaggtcagattttctatcgccgccgccgtcgccgcgtgaagcgtaaaagcggtaatatcgatgacttctgccgtcgctggggcagccagtacagctacatggtggtgctggatgctgactcggtaatgaccggtgattgtttgtgcgggctggtgcgcctgatggaagccaacccgaacgccgggatcattcagtcgtcgccgaaagcgtccggtatggatacgctgtatgcgcgctgtcagcagttcgcgacccgcgtgtatgggccactgtttacagccggtttgcacttctggcaacttggcgagtcgcactactggggacataacgcgattatccgcgtgaaaccgtttatcgagcactgcgcactggctccgctgccgggcgaaggttcctttgccggttcaatcctgtcacatgacttcgtggaagcggcgttgatgcgccgtgcaggttggggggtctggattgcttacgatctcccgggttcttatgaagaattgccgcctaacttgcttgatgagctaaaacgtgaccgccgatggtgccacggtaacctgatgaacttccgtctgttcctggtgaagggtatgcacccggttcaccgtgcggtgttcctgacgggcgtgatgtcttatctctccgctccgctgtggtttatgttcctcgcgctctctactgcattgcaggtagtgcatgcgttgaccgaaccgcaatacttcctgcaaccacggcagttgttcccagtgtggccgcagtggcgtcctgagctggcgattgcactttttgcttcgaccatggtgctgttgttcctgccgaagttattgagcattttgcttatctggtgcaaaggaacgaaagaatacggcggcttctggcgcgttacattatcgttgctgctggaagtgcttttttccgtgctgctggctccggtacgcatgctgttccatacggtcttcgttgtcagcgcgttccttggctgggaagtggtgtggaattcaccgcagcgtgatgatgactccacttcctggggtgaagcgttcaaacgccacggctcacagctgctgttagggttagtgtgggctgttgggatggcgtggctggatctgcgtttcctgttctggctggcaccgattgtcttctcgttgatcctgtcaccgtttgtttcggtgatttccagccgtgccaccgttggtctgcgcaccaaacgctggaaactgttcctgatcccggaagagtattcgccgccgcaggtgctggttgataccgatcggttccttgagatgaatcgtcaacgctcccttgatgatggctttatgcacgcagtgtttaacccgtcatttaacgctctggcaaccgcaatggcgaccgcgcgtcaccgcgccagtaaggtgctggaaatcgcccgtgaccgccacgttgaacaggcgctgaacgagacgccagagaagctgaatcgcgatcgtcgcctggtgctgctaagcgatccggtgacgatggcccgtctgcatttccgtgtctggaattccccggagagatattcttcatgggtgagttattacgaagggataaagctcaatccactggcattgcgtaaaccggatgcggcttcgcaataaaaacgtagttgcctgatgcgctacgcttatcaggcctacatcgttcctgcaatttattgattttgcaagactttgtgggtcggataaggcgttcacgccgcatccggcaaaaacaacgagccaataaaaataccggcgttatgccggtatttttttacgaaagaggtatcaaatgcgtttaattgtggtgagcatcatggtgaccttgctgagtggctgtggcagcattattagtcgcactataccggggcaggggcatggcaaccaatattatcccggtgtgcaatgggatgtgcgtgactccgcctggcgttatgtcacgatccttgatctgccattctctctggtttttgatactttactgctgccgatcgacattcatcatggcccgtatgagtgattaacgttcatcccactcatcagctgctgcgcgtccttcctcggtatccagcggtggctcaagctgaaattccccctcgtcccattcatgtaatgtattctcttcctgccactcctggcgtatctctatctcatcatagtcgccatcaaaaacactttgcgcggcttcaccgctaagcataggtaaacattcaccttcttccccttcgtcggcaaaaaactcaacttgccacatgatgtcgccgtcctgcaaaacgtatttttgggcattgaactgttgcacattcgcatcttcggcgtcgatgccggggttgtctgcaagaaattcttcgcgtgcagcgtcaatggcttcttcaagcgttgcgtacatggtcatcacgattctccctttgagttgatgaggtttcagggaaaaggatagctgattctccgcttttgcaagtatgaaaggcgaaaaatcagttcgatacctggggtattcgacgacgacgtagactgttccatgaatagactgcgttgaataacactacgccagcggtgacgagaaataccgctctgaaaccgtagttcgctgaaatcgctgctcccatcaatggtccggtaacgttgccaatatcacgaaacgattggttatagctgaagatacgcccggcgatctggttgctcgagttgtaaaccaacagtgtctgtacggcggggagtagtgcaccatcggcggcaccgagcaaaaaacgtaaaatcccaagttgcaatggcgtctgaacgtaagacattgggatcaacagcagtacagaaaagatcagcgctgtaatcaggatcttttcgggtccgattcgatcgccaagtttgccgagtcgtggtgcacttagcagagccgccacgcctggcaccgaggcgatcatgccactgataaaggcgacgttactgacgttacccgccagttcgcggacatacagcgtcagaatgggggcaattgagcccgtcgccacctggatgattaacgtagtgacaaacaggctgagtaccagtttcgggtttttaagtgatgtcaccacttcccgcatgtgcagcatctcttttttgctgaccggctggaatttttctctgatgcaaaacagggtgacgaaaaagcagagtatgagcacactggcggtaataaagaataccggacgtaagccgtagctatcggcgagcaggccgccagccattgggccgagcaacgcaccactaacgccgcctgtggagagcgtacccagcgcccagccgcttttattacgcggtacttgtgtggcgataagagcattagcgttggggacaaatccgccaagtaacccaagaagcgcccgcaggatcaaaaactgccagatattttgtgccagccccatcaacaccatcacgatgcccatgccgagggcagagcgtaatagcatgagttttcggcctttacggtcggcgagtccaccccaaaacggtgaggcgatggccgaaaataaaaatgtaatgctgaagacaataccggaccacatattcagggcggagtgaccggtaacgccaagctgctcaacgtagaggggtaagaagggcattaccagactgaaggcggcaccggtaagaaaacagcctagccaggcgacgatcaggtttcgtttccagtttataggggtgtcattttcacagggtgacatagcaatccgctgttggtgcgccaggcgcggtgaacataagaagaaaagataagcacactaattatgcgcccgacttccagggggcgcaatccagagagcttttatcgctaaatcagggggatttgctgtggtaatgccggatgccattctgaagcatccggcatgggagatttaatagcgtgaaggaacgccttccgggcgtgttttaaagcgacggtgtaaccacatatactgctctggtgccatcatgatgcatttttcgaccactttgttcatccacgcggcggtagtttcggcatcatccagtggcggagaacactctggcggcagcataatcaattgataccctttgccatctggcttacggcgtggaacgaagggcaccagacatgcgccggacatccgtgccagcatccaggttccggtcgtggtcgcagcctgctcaacggcaaacaacgggacgaaaacgcttgagcgcgggccgtaatcatgatccggtgcgtaccagaccacttcgccttttttcagggctttaatcatgccttttaaatctttgcggtcgagcatcgatttatttgagcgcaaacggccccaggtttgtagccagtcaatcagtggattatcgttcgggcgataaacgccaatacccggttcctgcataccaaactgccgcgcacccagctccagtgtcagaaaatggatgccaactaacaggatgccgcgtttttgcgcctgcacgtcacgaatgtgttccatgccgatcacttccgtccagcgggcgattcggcggtccggccagaaccacgccatgccggtttccatcaggcccatgccaacggattcgaaattcttcaccaccattttacggcgttcttgttcgctcatttccgggaagcacagttccaggttgcgatgcacaatttttgcgcgtcgtttcataaaacgtaacgccagttttcctaatccacaaccgaggcggtagataaccgggtagggcaattgcacgactaaccaaagtacgccaatacccaaccaggttaaccaataacgcggatgaagcagtgcggtggagaacttgggtagattcgtcatatcaatcctgtttttcaacctattcgggcaattgtatgtattgtcgcattttttcgcccgcaaccaaaatttgtggctgaagactgggcgaaattgccgcgcttgtaaataacaaataatttttaatgcgcaaatgtagcgtaaaatgtgtggatgttaattatcgataattgctatatcatgccgcggatttttactttcccatctcgcaggaaccgtacaccatgccagtgttacacaaccgcatttccaacgacgcgctaaaagccaaaatgttggctgagagcgaaccgcgaaccaccatttcgttttacaagtatttccacatcgccgatcctaaggcgacccgtgacgctttatatcagctgtttaccgcgctgaatgtttttgggcgagtgtatctggcgcatgagggcattaacgcgcaaatcagcgtacctgcgagcaatgttgaaacatttcgcgcgcagctctatgccttcgacccggctttagagggtttacgcctgaatatcgcgttggatgatgacgggaaatccttctgggtactgcgcatgaaggtacgcgatcgcattgttgccgacggtattgacgatcctcactttgatgccagcaatgttggtgagtatctgcaagcggcggaagtgaacgccatgcttgacgatcccgatgcactatttatcgacatgcgtaaccactatgagtatgaagtggggcactttgaaaacgcgctcgaaattccggcagataccttccgtgagcagctgccaaaagcagtcgagatgatgcaggcacataaagataaaaaaatcgtcatgtactgcaccggcggcattcgttgtgaaaaggccagtgcctggatgaaacataacggattcaacaaagtctggcatatcgagggcggaattattgaatacgcccgtaaggcgcgcgagcagggcttgccggtgcgttttattggcaaaaattttgtttttgacgagcggatgggcgaacgtatatcggatgagattatcgcgcattgccaccagtgcggcgcgccgtgcgacagccataccaactgtaaaaatgatggctgccacctgctgtttattcagtgtccagtatgcgcggaaaaatacaaaggttgttgtagtgagatttgctgcgaagaaagcgcgttaccgccagaagaacagcgacgccgtcgggcaggacgtgaaaatggcaataagatctttaataagtctcgtggacgtctgaatacaacactgtgcattcctgatccaacagaataaatatcattgccggatgcgtgccatccggcaacatttcacgcttacttctgctgtacgccttccactgaaataatcagatccacttcctgagaagctggacctaaatctgtcttgatattgaagtccttgagcttaattttgccttcggcctcgaagcctgcacgtttaccaccccatgggtcgtcgccctgaccaattaatttcgcttccagcgtgacgggtttggttacgccattcagcgtcagatcgccggtaatatccagttcgtcaccgtctttcttcacgctggtggaggtgaatgttgcctgtggatattttgcggtattgaggaaatctgcactgcgaagatgtttatcgcgttcggcgtgattagtatcgacgctggtggtgttaattgtcacattcactttatcggcagccggatttttttcgtcaaaggtaaaagtaccgtcgaaatctttaaaggtgccgtataaccagctatagccaaggtgctggatgcggaaattaacaaaggcgtgctgaccttctttgtcaattttgtaatcggcggcaaccgctgaaccggcagagaacatcagggacgcgaaggttaaaccaagcaggctttttttcattttttatactccatagtcagatgacgactttcccagcatgcgcttcagagtgtcgtctttatcgatgaaatgatgcttcagggccataaatccgtgcataacggacagtactacgacgctccacgcgagccaaaaatgcagggcaccggcaaagtctgcctgtgcgccagcgtcggcaagggtcgcggggacgtcaaaccagccaaaaacgctgatcggtttaccatcggcagttgagatcagatagccgctgatgccgatggcgaaaagcaataggtacaatgcgagatgtccagctcttgcggcaagacgagtcatgggcgaataactcggcagcggacccggcggtggagatatgacacgccacagaacgcgaataaccagccccatcattaacaaaataccgatgcttttatgcagttcgggtgctttgtgataccagccatcgtaataactgagcgtgaccatccacagacctaaagcaaacatgccgtagacaataattgcgcttagccaatggaaggccgcagatataacaccatagcgttcaggggtatttgtgaatgacataagtgcatccaaaacgaatttgcgagagaaagaaaatggcgtgtcggagaatgaattgcaacacaaaaataacaaattgaatgatatttatttttatttcaataattttgaattaataatgaaagaatcttcataagtttagtgggttcagcatcagagatgtctggtgagtgctgtagaagcaggaataatctcattcaatttttcacgctaaatgaaagggagattaaatatttgtcagtttatgtcagtgcggaaaactaaaaataaaacacatagatcagatccataattgccaacaatccccagagaaaaagataaagcatcagatgctcgcgaatattattgatgagatagtgcaacagccgacgcattaaatactcctgtaaaaacggcctcattctggaggccgtaatgatgattattggaagcgggaaagcctgaatggcgtcaaatcaaaatcgctttttttgtcttgcgcaaaatcggcagctatttcccctaaaactgacgcaaatttaaaaccgtgcccactcaggccggtaatgagcagtgtattatcgtggccgggtagggtatcgataataaaatcttcgtcaggcgaattatcataggtgcaggcagcgccgtacaggcagcaaccgatacccggcaatacattgcgcaagaacgggaaggcttctgacccatcactggccacttccgcaaacggaacacgttcatccgctgaatggataacctggcctccgttatgtttgccaatcttcaacgcgtcgttttctgccggaaaaccataatattgatcgccattgggcagttcaccggtaaacgccgggaatttattcttcacgctatagcggccatcggcctgataccaggcaaatactttgcgtacgggctggacaggcagctccgggagcaggtcttttacccatgttcccgcgcagacaatcgcttttttcgcctgatactcaccgtcagccgtttcaatagttacgccatcatcgtcatgacgaattgcggtgaccgggcagttgaacagttgcgcacagcccgcttccttcgccagttggatccaggttttaatcgccagttcgctgcgcaaaaaaccggaatcagtttcaaataagccgatgtagttgtccgggacgcgtatttccggccagcgggccataatcccttgcgcatcgagcttttcaacgttgagttgccattgttcggcgctgtgggcgacgttggcgagaaatgtggaatcagccgggccaaggttaatgacgccagagcgtacaaaaatgggatcttcttcgttgtggcgggagagttcatcccacagcgtttgcgcgcggaggaccagcgggacatacttttcgccttcaccataagcatggcgaattaatcgcgtatcgccgtggtggctgccgtgttgatgcggtggcatatgggcgtcggtcattagcacgtttaaaccggcgcgggttgcataatacccggcggcagcgcctacggaaccgctgccaataatgatgagatcgtatttcatttttttctctctgctctcatggtttaagcagagtaattaactgaatgcagatatacaacccagaaatggtaaaggcaccggtgaggtgccttttgggtggatggtcatgtcatgttaatgacgccgatactcgtttacctggaaatcaccggattcaattttggcgattcctgcttctaatatcgaaataaattgtctggcaacatcagtggttaaccagagcgtctgaccaacttcagtcccttcctgctcggacttatttggggtctggtagtgcaaacgcaacatcagcgcatcatagctatcaacggtgctgatgtcccaccctacgagcggatgagtctgaatgacttcattatttttttccatcatggccccctaattcgtgttactagacaacgttattcgaggttcaatgcgtttttatctgaagcaacttcagtataccaataagtaagggtattcaccgaatttttaaagggggaaacagataaatttctgcttttaagatttatatgaacaataaaacagcatgtcattcatatttttttagcatattgtgcaattattttgaggaagtgtagaaattttgtactcaaaattcgtaagtaaaataaaaaagccggggcgacccggcaaaaaaaatcactgcatattattcgctgacaaaccagtcatcggcgctttcccacgtttcctggagaatttcactaatgcgctgtttatcttcttttgtcgcgccaataaccgataaattattcgctgcggcataacgtaccgatacgtggccttcattatcaggaaacgcatactgaatacggcgggaaagttcgccagccagggcgtcaatagccccagctggcaatggagaagttttcgctatggtgacttcaattcgcataatagccccctgttgaatatactggttatttatacaggtaaaataacctaatgacaacaggaagctacgatttttattgtttaacggaccagcgtaccgtttccccggcgaggaatggcaccagcgtgtcatcagtcagtgcgatgctttcagcaacctgttgctcttcacgtaccagttcgatgaatgtgtcgttgaccggcaacccatagaactgcgggccgtttacagaacagaatgcttcaaagtgctgcaaagcattcatttcttcaaagacggtagcgtaactgcccagcgcggttggggcgttgaagcagcccgcgcagccgcaactgctctctttgcgatgacgtgcatgtggcgcagaatccgtaccgaggaatactcgattaaaaccgctggcgaccagttcacgcaatgcctgttggtgaatattacgtttgaggatgggtagacaatacaggtgcggacgcacgcctccaaccagcatatggttgcggttaaacatcagatgctgcggagtgatggtggcagccagccgttcatttccgtcacggacatagtcggcagcatctttggtggtgatgtgctcaaaaacgactttcagcgcagtcaggcgctggcgcagaggttccatcacgctttctataaagcgcgcttcacgatcaaaaatgtcgatatctgcatgtgtcacttcaccatgcaccagtagcggcataccgattttttccatgcgctcaagtaccggcatgattgcgtcaattgacgtcacgccgtggctggagttagtggttgcgtttgccgggtaaagttttgcagcggtgaacacgccttcgttaaatccgcgctccagctcattaggatccagcgaatctgttaaataacaggtcatcaatggggtgaaatcgtgcccggcaggtacggcgtcaagaatacgctggcgatacgccacggcagcctcaacggtggtcacgggcggagccagattgggcattacgatagcccgtccataaatttcgctggtatatggcacgacagtttttaacatgtcgccatcgcggaggtgaaggtgccagtcgtctgggcggcggatctttaatacctgggatggtgcagtcattaatctctatgctccggctgaagggatgtttttgccggacacaaaggataagcggaaacgttttcctttgcacgaaaaataaagggcgcgaatgcgccctcgtgattaatcagtaaatggaatgacaatttcgcctggcttcacttcaatgcctttcgccagttttttcgccattgcttcgccctggctgccatcttcgcgcaggacgtaagcaggttgctggttaaagtaattgcgtaatgcctggttcaaatagggaagcaacgtttgcatcaccgtttgcattttttccggttgtaccgtcgcatcgaccacttccatctctttcaggaagatcgcacctttttctttatcaaacacgggcagcgctttcagcttcagtttcatggtcgctttctgactaccgaacagggagttcatgtccagattggcgtctccggttagggtaaccttattcggctcttcgcgaccaatttggctggtcaggtttgtcagaacaatatgggcgtcagccacgccgggtaaaccgatatcttttgagaaattattatgtttcgcaagcgactggttaatttcttgttcggtgatggtgtattgggtgagttgattacagccaacgagcaggccactgacgatcaatgcagcggcaaataaaaacttgttcatggtagtcctcgacatgaaatctgcgtcaatatcctgacacaacgcagcatgtgtcaccagcgataaactcgccagcagaaaaaactgaaaacggcggcaacccgcgaatacaggctgccgcggcgggtcaggattaaatcgccattgatgataacaaattgatttgtgtctgtttcgccatattatcgcggtaatcagcaacgcggcttggccagttaattccggctaccagcgtcagattacgcagtagcgggaatagctgaatatcatcttccgaaagttcgccattcacggcgttcggtttgacgatcagtttgtccagcgcacgtaaatcatcgctgatattcttaatcagaccgtcagagtgggccagcaggtcggcaaaattacccgcgctggcctctttcttgtcgacgaaatatttgcgcgcggcgggagtagaaaactcatcaaatgccgatttggcaaaacgcggcaacagcagtttgttggcgtagccattgaccttgcgcagccactcttcaatggcaggggaacgtttgccggtcagtaacggtttgccgtcgagtttatcgacatagtgaacgatgtccatgctttctggcatatagcggctgtcatctttttgcagaatgggaacctgtttttgaccgaccatccgggtgggtgtttctgcgtcgtcgttgagcagaacatgtaattcgacggggatatttttcaggccgaaaatcatgcgggctttgaggcagtaagggcagtgatcgtaaatgtatagcttcacgtgactcctccatttggctgtcagttcactttcagtatgaaggagtcaggggggagtatcaaatcaggcgtcgcgttcaagcaaacgacgcgcggcgcgtttctggctaaactgccaacccagcgcaaggaaagtgaagatgccaataatgcccagcatcatccacggaagctctggctggtgcgccgatttgcccaggtcaaacagccagccgccaccgatataaccaatagcgccgccaatcgccagacccagacggctaaaccccatatagctgccgcgagctcttgcgtccgccagcgaagcacttaaggtttcacgcgcaggctcggcaatgatcgacccgatataaaacagacaaatcagggtgaaaagttgttgcaggccgctgaccatgcccaccggcatcatgcttaatgacattatcaacagcccagccatcaaccggtgttccagacgaaaatgcttttcactccagcgggcgatagggtagagcaacgttaacgacagacacgcttcaatggcatacatccatttaacggcagagggcgcgccagccacgtcgttgaccataattggcagcatcagcatcacttgtacagccagcatgtagtaacccgccagcgtcagaacataggtgacaaaacgcttgtcacgcatcacgcgggtcatgccttcgcgaacgggcgtgcgtacggtggagagtttccatgctggtaacaaccacgcattgaacgccgcacatagcacaaatagaactgcccctgtggcgcagaccaggcgaaagtcgtattgcaacagccagctccccaacaatgcgccaatgaccgcaccggcactgtcctgcatcatcaacagcgagaaaaaacgaccacgctgctgtggacggattaatttcaccaccagcgccgaacgcggcggatcaaacaacgtgccaccgagtcccgagagcaggcatgaaaaccacaatagccacggttcgtgggcgatacccattgtggcgaatccggcggcgcgcatcagcataccggtaacaatcatcggtttggcaccaaagcggtcggcaattgcaccgccgaaaatacccagaccttgctgaataaattggcgtagaccgagagcaataccgaccatgacggcggcccagcccatttgatcaacgaagcggatagagatcagcgggaagacaacaaagaaccccagcacgaccagcatattatcgatgagcaggaaatatttacccaggttcctcgcctgcgacacgcgggacatttcccctcccgggaaataaaagatgagcactttctattctgcattgccgctaagacttttcccatcacttcggggacaatatttttttatcaaaacgtcgctttgatagagagtttttatcaaatatgtgaataatgcagaaaatggcattttggacttttcacagggtctggttgcgcaggtatagtaatacttacagcgtattaaagacgttacgggaaggagtaggtatagaatgtttggctatcgcagtaacgtgccaaaagtgcgcttaaccacagaccgactggtcgtgcgtctggtgcatgatcgtgatgcctggcgtcttgcggattattacgcagagaatcgccatttcctcaagccctgggagccagtgcgcgacgaaagccactgttatccatcaggctggcaggccaggctggggatgattaacgaatttcataaacaaggttcagctttctactttggcttattcgacccggacgaaaaagagattattggcgttgccaatttttccaatgttgttcgtggctcttttcatgcctgctatctcggttattcgattgggcaaaaatggcagggcaaaggactcatgtttgaagccctgaccgcagccattcgttatatgcagcgcacccaacatattcatcgcattatggctaattatatgccgcacaataaacgcagcggtgatttactggcgcgactgggttttgaaaaagaaggctatgcgaaagactatctgttgattgatggacaatggcgcgatcacgtactgacggcattaactaccccagactggacgcccggccgctaaggagaatctcatgaaatatcaacttactgcccttgaagctcgcgtgattggttgcttgctggaaaagcaggtgaccacgccggagcaatacccgctctcagtcaatggtgtagtcacggcctgtaatcagaaaacgaaccgtgaaccggtcatgaatctgagtgaatccgaagtgcaggaacagctggataatctggtcaaacgtcattatctacgcacagtgagcggttttggtaatcgggtcaccaaatatgagcaacgtttttgtaattcagaatttggcgatctgaaactgagcgcagcggaagtggcgttaatcaccacgttgttattgcgtggtgcccagacgccaggtgaactgcgcagccgcgccgcgcgaatgtatgaattcagcgatatggcggaagtggagtcgacgctggaacaactggcaaatcgcgaagatggtccttttgtggtgcgtctggcccgcgaaccgggtaaacgcgaaaaccgctacatgcatcttttcagtggtgaggttgaagatcagccggcggtgacggatatgtcgaacgcggttgacggtgatttacaggcccgcgtcgaagccctggaaatcgaagtggcagaactgaaacagcgtcttgattcgttgctggcccatctgggagattaaagtgaaaaaattacgtatcggcgtagtgggattaggtggcattgcgcaaaaagcgtggttaccggtgctggcggcagcgtctgactggacgttacaaggagcctggtcgcctacgcgcgcgaaagccctgccaatttgtgaaagctggcgcattccttatgccgattcgttatccagccttgccgccagttgcgatgcggtttttgtgcattccagcaccgccagccactttgacgtggtcagtacgttactcaatgcgggggtacatgtctgtgtcgataaaccgctggcagaaaatctgcgcgatgctgaacggctggtggaactggcggcgcggaaaaaactgacgttgatggtcggttttaaccgtcgtttcgcaccactctacggtgagttaaaaacgcaactcgccaccgcagcctcgctaagaatggataaacatcgtagcaatagcgtcgggccacacgatctttatttcacgttgctggatgattatctgcatgtggtggataccgcgctgtggttgtcgggcggcaaagcctctctggatggcggtacgctactgactaacgacgctggcgaaatgctgtttgccgagcaccatttttcggctggtcctttgcagatcaccacctgtatgcatcgccgtgccggaagtcagcgtgaaaccgtgcaggccgtgactgacggtgcgctcatcgacattacggatatgcgcgaatggcgtgaggagcgcgggcagggcgtagtgcataaaccgattcctggttggcagagtacgcttgagcaacgtgggtttgtcggctgtgcgcggcacttcattgaatgtgtgcaaaaccagacagttccgcaaaccgccggcgaacaggccgtgctggcgcaacgtatcgttgacaagatctggcgcgatgcgatgagtgaataaaccctgtaacatctggcggtagcaattcaccataatccaggtagactattcgcctctttcagcgcctgccttgcaggcgttttgcccgtgggtctggattagaacaccgatgaatttattaaaatcgctggccgccgtcagctcgatgaccatgttttcgcgtgtgcttggcttcgcacgagacgcaattgtcgccagaatctttggcgcagggatggcaaccgacgcctttttcgtcgcttttaaacttcctaacttgttacgccgtatctttgccgaaggggcattttcccaggcatttgtaccgattctggcggaatataaaagtaagcagggtgaagacgccacgcgggtctttgtctcttatgtttctggcctgctgacacttgcgctggcggttgtgacggtcgctggcatgctcgccgcaccgtgggtgatcatggtgaccgcgccaggcttcgctgacacagctgacaaatttgccctgaccagccagctactaaagattacctttccctatatcttgctgatctccctggcgtcgctggtgggagcgattctgaatacgtggaaccgcttctcgattccggcgtttgctccaacactgcttaacatcagcatgattggtttcgcgctgtttgccgcaccgtactttaacccaccggtgctggcgctggcgtgggctgttacggtcggcggcgtcctgcagctggtgtatcagctaccgcacctgaagaagatcggcatgctggtcctgccgcgcattaacttccacgatgccggagcaatgcgcgtggtgaaacagatgggaccggcgatccttggcgtctctgtgagccagatctccttaatcatcaacaccatttttgcctcgtttcttgcttccggttcggtgtcttggatgtattacgccgaccgcttaatggagtttccgtccggtgtgctgggcgtggcgcttggcaccattttgctgccgtcgctgtcgaaaagttttgccagtggcaatcatgatgaatacaaccgtttgatggactgggggttgcgtctttgtttcctgttggcgctgccgagtgcggttgcgttgggcattctttccggtccgttgaccgtttcgctgttccagtacggtaaatttaccgcgtttgatgcgctgatgacccagcgggcgttaattgcctactcggtgggtttgattggcctgattgtagtgaaagtgttggctcctggcttttattcccgccaggacattaaaacgccagtgaaaattgccatcgttacgctgattttaacgcaattgatgaacctggcgtttattggtccgttgaaacatgccgggctgtcactttctattggtctggcggcgtgtctgaatgcttcgctgctttactggcagttgcgtaagcagaaaatctttaccccgcaacccggctggatggcgtttctgttgcgtctggtggtggcggtactggtgatgtctggcgtgcttttaggtatgttacatatcatgccggagtggtcattgggtaccatgccctggcgtttactgcgtttaatggcggtcgtgctggcggggattgccgcgtacttcgctgcactggcggtactgggcttcaaagttaaagaatttgcccgccggacggtgtaacaatgcattccggcctgcagtgcaggccggagataatcttcagatcgaaatctttttaccgccgcgatgggttgttgaggtctgaccgttcgccccatatagcgtcggttcctgatgcggtttcaacatttccagcgcctgttgattgcgctcaatctgtccttccagtaaccagccgttatgttgattcatttggcgtagttgctgcgttttcacagtaatttcctgccagcgttgactaatatcaacgctatttgctgtattgggttctttcctgcgtaactgttcgaggtaatccagcgtcgccagcagtgagcttttttgttctgtaatccattgcaactggctgccgttgatctgccccatagagagatgttgctgctcttgatccattaccgttttgagatcgttaagcacagcggacatctggtcgaggatctctgcaagacgtgtcatacgatcagttactctgcaagtcttgctgcgcttcgttgatcagcgcatcggcaattttgccggtgtccatttttagttcaccgttacgaatcgccagttttaacgcttcgacacgttcaagattgatatcactgctgccgggttgcatcagttttgcttgcgcgtcgcttaacgtcacactggtgctggtggaggcggttgtttttgccgcccggctgttcgttaccggcgcgtcagtggtttcgcgcggttgaacggtgcttacaggcttcagaggcgaagtgcgatcaatactcatggtttattcctcattgagggcgcttttatcatgtgttgcttatttatcggcaagggacgggtaatctttaacagcttacaggtttataagaatattcccatctgcatcaacaacgccgctgactacctgtcccgataccatgcgcacccgcgcattctgtgcgacggctgcattgttcagcgcctgaccttctgcgttggcgctaaacccatcaccgctggcgatcacattgacgcgttgtcccgcttttacccgccatgcctggcgaaactgggttaactggataggttgatcgggtgatagatcgcgcaggctaatggcatcaacaagttgattgatatccagcaccgtacgcggtggcagggtatccagccgtccgcgtttcagtttgacattgccagcttccagctttcctccccgcgcaatgggcatcgcggcaaccacataatttcctgtggcctgtacattaacctgtaaatatcgtttgtcgttaccgcagcgtgccaacacattcacattgccccacaggcgggaattattgctcatcgaaagcaatggctgctcgcatggcggtagtagattgggcgctgtacgaatagaaacacgaacctcatcacttacccccgcgagttgggcgctaaaaaagttgtgcaattgcgatgtgagattgctcgccgtacttaacggactgaacagtatcgcgatgatcgccacgctacgttttattatcagcattttcgcccccagccatttctacaacgtgaattgtacctgtccgcaatgaccatcaacggcataaatagcgacccattttgcgtttattccgccgataacgcgcgcgtaaaggcatttaagctgatggcagaattttgatacctgcggaggagatatgctcgataagctcgacgccgccttacgttttcaacaagaggcgctcaatctgcgcgcccagcgtcaggaagtgctggcagcaaacatcgccaatgccgatacccctggttatcaggcgcgcgatatcgattttgccagtgaacttaaaaaagtcatgcaacgtggacgggatgcaaccagtgtggttgcactgacgatgacctcaacgcaacacattccggcgcaggcgctgacgcctcctaccgcagaactgcaataccgtattccggaccagccttcgcttgacggtaataccgtcgatatggatcgcgaacgcacccagtttgccgataacagcctgcaataccagatgagccttagcgcgttgagcgggcaaatcaaaggcatgatgaacgttttacagagcggaaattaacggatggcactgctgaatatttttgatatcgccgggtcggcgttaactgcccagtcccagcgcctgaacgtggcggccagtaatctggcgaatgctgatagcgtgaccggtcccgatggacagccatatcgggcaaaacaggtggtattccaggttaacgctgcaccaggtgctgcgacaggcggcgtaaaggttgccgatgttatagaaagtcaggccccggacaaactggtttatgaaccgggtaatccgctggcagatgcaaagggctacgtaaaaatgccgaacgttgatgttgtcggagagatggttaacaccatgtcggcgtcacgcagctatcaggccaatgttgaagtgctcaacacggtgaaaagcatgatgctgaaaacccttacgctcggtcaataaaggagaaagctatgtccattgcggtaaccaccaccgatccgacaaataccggcgtcagtaccaccagcagtagttcgctcacgggcagcaacgccgcagatttacaaagcagttttctgactttgctggtggcgcagctgaaaaaccaggacccgaccaatccaatggaaaacaacgagctgacgtcgcaattggcacaaatcagcacggtcagcgggattgaaaaactcaataccacgctcggatctatttccggacagattgataacagccagtcgttacaggccagtaacctgatcggtcacggcgtgatgatccccggcaccactgttcttgcgggaaccggcagtgaagaaggggctgtgaccacgaccacgccgtttggtgttgagctgcaacaggcggcagacaaagttacggccaccatcaccgataaaaatggcgcggttgtgcgcaccattgatattggtgaactgaccgccggagttcacagtttcacctgggacggtacgttgactgatggcagcactgcgccgaacggttcttacaatgtagcgattagcgccagtaacggtggtacacaactggttgcccagccgctgcagtttgctctggtgcagggtgtgatccgcggcaacagcggtaatacgctggatctcggcacttacggcaccaccaccctcgacgaagtacggcagataatttaagccttcacatttcaggagtcagtcatggccttttctcaagcggttagcggattaaacgctgccgccaccaacctcgatgttattggcaacaatatcgccaactccgccacctacggctttaaatcaggcacggcctcttttgccgatatgtttgccggttcgaaagtgggactgggggtaaaagttgccggtatcactcaggactttaccgatggcacgaccaccaacaccgggcgaggtctggacgttgctatcagccagaacggttttttccgtctggtagacagcaacggttcggtgttctacagccgtaacggacaatttaagctggatgaaaaccgtaacctggtgaatatgcaaggtttacagctgacgggttacccggcaaccggtacgccgccgactattcagcaaggggcgaatccgaccaatatttcgatcccgaataccctgatggcagcgaaaactaccaccacggcatcgatgcagatcaacctgaattccagtgatccgcttcctactgttacgccattcagcgccagcaatgcggatagctataacaaaaaaggttcggtgactgttttcgacagtcagggtaatgctcatgacatgagcgtctactttgtgaagaccggggataataactggcaggtctacacccaggatagcagtgatccaaacagcattgcgaagacagcgacaacactggaatttaatgctaatggcacattagtggatggtgcgatggcgaataatatcgcaaccggcgcaattaacggtgcagaacccgccacgtttagtctgagcttcctcaactccatgcagcaaaataccggcgctaacaatattgtggcaaccacccagaacggctacaaaccgggcgatctggtgagttatcaaatcaatgatgacggtacggttgtcggcaactattccaacgaacaaacccaactgctggggcagattgtactggcgaactttgccaacaacgaaggtctggcatccgaaggcgacaacgtctggtctgcgacgcaatcttctggcgtggcgctgttggggacagccgggacgggaaactttggcaccctgaccaacggtgcgctggaagcgtccaacgtcgatctcagtaaagaactggtcaatatgatcgttgcccagcgtaactatcagtctaacgcccagaccatcaaaacccaggaccagatcctcaacacgctggttaacttacgctaatcgctgacgggatagctcaatggatcacgcaatttataccgcgatgggagcagccagccagacactgaatcaacaggcggtaaccgccagtaatctggccaatgcctcaacgcccggttttcgcgcgcagttgaatgctttacgcgcggtgccagtggaagggctttctctgcccacgcgcacgttggtcacggcgtcaacgccgggcgcagatatgacgcccggcaaaatggattacacctcgcgcccgctggacgtcgcgttgcagcaggatggctggctggccgtgcagaccgctgacggcagcgaagggtatacgcgtaatggcagcattcaggttgatcccaccgggcaactgacaattcaggggcatccggtgataggcgaggctgggccaattgctgtgccggaaggggcggaaatcactattgctgccgatggcacaatctcggcgctcaatccgggcgatccggcaaatacggttgcgccagtagggcgtcttaaactggtgaaagccacgggcagcgaagtgcagcgcggtgacgacggcatttttcgtttaagcgcagaaacccaggccacgcgtgggccggtactgcaggcagatccaaccttgcgtgtgatgtcgggggttctggaaggcagtaacgtcaatgccgttgcggcaatgagcgacatgattgccagcgcgcggcgttttgaaatgcagatgaaggtgatcagcagcgtcgatgataacgcaggccgtgccaaccaactgctgtcgatgagttaattgaaaggatacatgacaagtataagttgcccgatgcgcaagtttatcgggtctatgggggcaatcgcaatttatcgattttgcgagcacttgtaggccggataaggcgtttacgccgcatccggcaagaagacatatgcactttgtcactaatccactacaggacattttatgatcagttcattatggatcgccaaaacgggccttgacgcccagcaaaccaatatggacgtcattgccaacaacctggcaaacgtcagtactaacggttttaagcgtcagcgcgcggtgtttgaagatctgctttatcaaaccattcgccagccgggggcacagtcttccgaacaaaccaccttaccctccggattacaaatcggcacgggggtacgcccggtcgccactgaacgcttacacagccagggaaacctgtcgcagaccaacaacagcaaagatgtcgcgattaaagggcagggctttttccaggtgatgttgccagatggttcatcagcctatacccgtgacggctctttccaggtggatcagaacgggcagctggtgacggctggtggttttcaggtgcagccagcgatcaccattccggcgaatgcgttaagtatcaccatcggtcgtgatggcgtggtcagcgtaacccaacaaggccaggcagctccggttcaggttgggcagctcaatctcaccacctttatgaatgacaccgggctggagagcattggcgaaaacctctacaccgaaacgcaatcctctggtgcaccgaacgaaagcacgccgggcctgaacggcgcgggactgctgtatcaagggtatgttgaaacgtctaacgtcaacgtggcggaagaactggtcaatatgattcaggtgcaacgcgcttacgaaatcaacagtaaagcggtgtccaccaccgatcagatgctgcaaaaactgacgcaactctaaggcttaaccggtggcaggttcaccggtttactgatttttgaagatgatagccatgcaaaaaaacgctgcgcatacttatgccatttccagcttgttggtgctttcactaaccggctgcgcctggataccctccacgccgctggtgcagggggcgaccagtgcacaaccggttcccggtccgacgcccgtcgccaacggttctattttccagtctgctcagccgattaactatggctatcaaccgctgtttgaagatcgtcgaccacgcaatattggcgatacgctgaccatcgtgttgcaggagaacgtcagcgccagcaaaagctcctctgcgaatgccagccgtgacggtaaaactaattttggctttgatactgtgccgcgctatttgcaggggctgtttggtaacgctcgtgccgatgtcgaagcctccggtggtaacacgttcaacggaaagggcggggccaatgccagcaatacctttagcggcacgttgacggtgacggttgaccaggtactggtcaacggcaacctgcatgtggtgggtgaaaaacagattgccattaatcagggtaccgaatttattcgcttctctggcgtggttaatccacgcactatcagcggcagcaataccgtaccgtctactcaggtggcggatgcgcgcattgaatacgtaggcaatggctacattaacgaagcgcaaaatatgggctggttgcagcgtttcttccttaacctgtcgccaatgtaagtgaggctgtggtgattaaatttctctctgcattaattcttctactggtcacgacggcggctcaggctgagcgtattcgcgatctcaccagtgttcagggggtaaggcaaaactcactgattggctatggtctggtggtggggctggatggcaccggtgaccagacaacccagacgccgtttaccacacaaacgcttaataacatgctctcacagctgggaattaccgttccgacgggcaccaatatgcagctaaaaaacgtcgctgcggtaatggtgacagcgtcacttcctccgtttggacgtcaggggcaaaccatcgatgtggtggtttcttccatgggaaatgccaaaagcttgcgtggaggtacgttgttgatgacaccgcttaagggcgttgacagtcaggtgtatgcgctggcgcagggcaatattctggttggcggcgcaggagcctccgctggcggtagcagtgttcaggttaaccaactgaacggtggacggatcaccaatggtgcggttattgaacgtgaattgcccagccagtttggcgtcgggaatacccttaatttgcaacttaacgacgaagatttcagcatggcgcagcaaatcgctgacaccatcaaccgcgtgcgtggatatggcagcgccaccgcgttagatgcgcggactattcaggtgcgcgtaccgagtggcaacagttcccaggtccgcttccttgccgatattcagaatatgcaggttaatgtcaccccgcaggacgctaaagtagtgattaactcgcgcaccggttcggtggtgatgaatcgcgaagtgaccctcgacagctgcgcggtagcgcaggggaatctctcagtaacagttaatcgtcaggccaatgtcagccagccagatacaccgtttggtggtggacagactgtggttactccacaaacgcagatcgatttacgccagagcggcggttcgctgcaaagcgtacgttccagcgccagcctcaataacgtggtgcgcgcgctcaatgcgctgggcgctacgccgatggatctgatgtccatactgcaatcaatgcaaagtgcgggatgtctgcgggcaaaactggaaatcatctgatgatcagcgacagcaaactactggcaagtgcggcctgggatgcgcaatcactcaacgaactaaaggcgaaagcgggcgaagatccggcggcaaatatccgtccggtggcccgtcaggtggaagggatgttcgtgcagatgatgttgaaaagcatgcgcgacgctttaccaaaagatggcctgttcagcagcgagcacactcgcctgtataccagtatgtatgaccagcagattgcccaacagatgacggcgggcaaaggtctggggcttgcagagatgatggttaaacagatgacgccagaacaaccattgccagaggagtccacgccagcagcaccgatgaaattcccgctcgaaactgtggtgcgttatcaaaatcaggcgctttcgcagctggtgcaaaaggccgtgccacgtaactacgatgattcgctgccgggtgacagtaaagcattcctcgcgcaactctcgctgcccgcccaactggcaagccagcaaagcggtgtgccacatcatttgatcctcgctcaggcggcactggaatctggttgggggcaacggcaaatccgccgcgaaaacggcgagccgagctataacctgtttggtgtcaaagcctctggcaactggaaagggccagttactgaaatcaccacgactgaatatgaaaacggcgaagcgaagaaagtaaaagcgaagtttcgcgtctacagctcgtatctggaagccttgtcggattacgttgggctgttaacgcgtaacccgcgctacgccgccgtgacgaccgccgcgagtgcggaacagggggcgcaggccctacaggacgcgggctatgccaccgatcctcactatgcccgcaaactcaccaacatgattcagcagatgaaatcgataagcgacaaggtgagcaaaacctacagtatgaacattgataatctgttctgaataactcaagtccggcgggtcgctgccgataatactctgtaattgaaggcttataaggaacctccatgtccagcttgattaataacgccatgagcggactgaacgcggcccaggcggcgttaaatacggcaagtaataatatctccagctataacgttgccggatatacccgccaaaccactattatggcgcaggccaatagcacgttgggcgctggcggctgggttggcaatggtgtctacgtttctggtgtgcagcgtgagtatgatgcgtttattaccaaccagttacgtgcggcgcagacgcaaagtagcggtctgactgcccgctatgagcagatgtcgaaaatcgacaatatgctctccaccagtacctcttcgctggcaacacagatgcaggatttcttcaccagcctgcaaacgctggtgagtaacgcggaagacccggcagcgcgccaggcgctgattgggaaatcagaaggattggtgaatcagtttaaaaccaccgatcaatatctgcgcgaccaggacaaacaggtcaatatcgcgataggtgccagcgttgatcagatcaacaactacgctaaacaaattgccagcctgaacgatcaaatctcgcgcctgacaggcgtgggggcaggggcgtcacctaacaatctgctggatcaacgcgatcaactggtgagcgaattaaaccagattgttggtgtagaagtcagcgttcaggatggcggcacttataacatcacgatggccaatggttactcactggttcagggaagtacggcgcggcaactggcggcagttccttccagcgctgacccttctcgtacgactgtcgcttatgttgatgggacggcaggcaatattgagatcccggagaaattactgaataccgggtcgctgggcggcattctgacattccgttctcaggatctggaccagacgcgtaatacgcttggacaactggcgctggcatttgccgaggctttcaacacccaacacaaagccggatttgatgctaacggcgatgccggtgaagatttctttgctatcggtaagcccgcggttctgcaaaacacgaaaaacaaaggtgacgttgcgatcggtgccacggtaactgatgcctccgcggtactggcgacagattacaaaatctcgttcgataataatcagtggcaggtcacccgccttgccagcaataccacttttacggtgacgccggatgccaacggtaaagtggcatttgatggtctggagttgacgtttacaggaacgcctgccgttaacgacagcttcacgctgaaaccagtaagtgacgccatcgtcaacatggatgtattaatcaccgacgaagcgaaaatagcgatggcgagcgaagaagatgcgggtgatagcgataaccgcaacggtcaggccctgctggatctgcaaagcaacagtaaaacggtgggcggtgcgaaatcctttaacgacgcttatgcctcgttagtgagtgatatcggtaataaaaccgcgacgttgaaaaccagtagcgccacgcaaggtaatgtggtgacgcagctttccaatcagcagcagtcgatttccggtgtcaatctcgatgaggagtacggaaatctgcaacgttttcagcagtattacctggcgaatgcgcaggttctgcagacggcaaacgcgatttttgatgcgctgattaacattcgctaaggggagataagatgcgtttcagtacacagatgatgtaccagcaaaacatgcgtggtatcaccaattctcaggcagaatggatgaagtacggcgaacagatgtcgacgggtaagcgagtcgttaacccttctgacgatcccattgctgcatcacaagccgtagttctctcccaggcacaggcgcaaaacagccagtacacgctggcgcgtactttcgccactcaaaaagtgtcactggaagagagtgtacttagccaggtcaccactgctatccagaatgctcaggaaaaaattgtctacgccagcaatggcaccttgagtgacgatgaccgggcctcgctggctacggatattcaggggcttcgtgaccagttgctgaatctggcaaacaccactgacggtaacgggcgctacatttttgccggttataaaacagagactgcgccgtttagcgaagagaaagggaaatacgtcggtggagcagaaagtattaaacaacaggtcgatgcttcgcgttcgatggtgatagggcacacgggtgacaaaattttcgacagtattaccagcaacgcggtagcggaaccagacggtagcgcttctgaaaccaatctttttgccatgctggatagtgccatcgcagccctgaaaacgccggtcgcggatagcgaagcggataaagaaaccgccgctgcggcgttagataaaaccaaccgcggactgaaaaactcgctgaacaatgtgctgactgttcgcgcggaattaggcacgcagctgaacgaactggagtcgctggattcattaggtagcgatcgcgctttagggcaaacgcagcagatgagcgatctggttgatgtggactggaatgcaactatttcatcttacatcatgcagcaaacggcattgcaggcatcgtataaagcatttaccgatatgcagggattgtcgctcttccagctcagcaaataatttcgctttaaaacatatcatgaaactgggtatgttttgtctgcctgctctgggatcgctggggcgggcatttttttgcctattttgcattgttggttagcaaggatgccattcgatgaattttaatatgttgattcaaagatgaaataaaaaagccctggcagttaccagggcttgattactttgagctaattattactcaacaggttgcggacgcgcaggagcggcagaggcatgatgtgttgccgtatgaccacctgcggcacctttaccttcgaaggcaaaagtagggcgctgccagtcactgtgacgcggtgcctccggaacatattccggtgctggagcgcgcgtcattggcgcggtagcgtggttatgctcaacggtgacctcaggttcgaccgcagctaccgtttcaacttctgctgcgacttcagcgactactggcgcggcaggttgagcaacaacttcaggttcagcaactacaacctcagcagtttcgacaacttcttcaatatctgccgtctcttcctgcggttcaaccaccggttctgcttgttctgcaacttcctgggctacggcaacatcagactcggtaatcacctgcggctgttcagttaccgcggcagcgatcacttcaggatgcgtcgtttcaaccacttccggttgcggttcggcaacctgaacgggggcttctacgacaccggccacttcttcaacaactggcgcgctaacaaccggttcgatagcggcggcgacagggacctcagtcaccatcggctgcacatgtacttcttcctgttcgcgctgctcttcaacctgtacatcttgcggacgtacaattggatagcggatccagactttgccagaggccagttccggagacgcgcacgctacggtcaacggcattggcgactgggttggataacgctcgtcacgatagcgacgacgacgctgaccacttacgcgcaggtgacgaggcgagcggcgagaacgacgcggcatgccaccgttgtcacggttatcagcattgttctcttcttgctgttctggtgcagtttgcgctacgactggcagcgggactttcaccagttctgtgcgtggagctggcgcttcctgaacaattggttcggcagcgacagtttcttcaaccaccggtgcgactaccgcttcttcggctacgctttgctcgtaacgcactttctgattgagctgacgctgtttacgacgcggctgaaccggacgtacacgttcttcctgttcggtttcctgaacagattgctcttcaacattcagcgccttcgcttcttgttgcgcctgacgtttatcatcattacggcggcggctacgttcacgacgcggcgcttgctgctcgtcggcggtacgcgctttttccgttacctcagcctgctgacggctctcacgcgtctcggcagtctgctgctgtgcctggcgacgattacgacggttttcttcgcgattatcgctgccttcagtacgttcactacgggtgtcgcggcgctcattacggtcacggcggttgttctgacgaggcttgcgacgatcctgttgacgttccggtttcgcttctgctttcggtgctggttgctcggtcggtttggtttcttcaccaccgctgaacagcgctttcagtgcgccgaagaagcggctcaacagcccaggttgtgcaggagctgctggtgttgccggtgcagctttcggtgctggagctacaacaggcgcggcaggttcagctggcgttggcgcaggcggcacatccggcatggcaaaggttgccagcgcaggttgttccggacgcttacgttcagcgaactcttcttcagacggcagcgccatcgcttcttcatgcagcttcggcagcatgtagcttaaggttggggtttcttcccctttacgcacgcgcagcacgtggtagtgcggggtttccatctgatcgtttggcacaattacacagcgcacaccgtcctgacgagtttcaatggcatttaccgcagaacgtttttcattcagcaggtaagaagcgattggcacaggaacaatggcgtgaacttcctgggtgttctctttcagcgcttcttcttcgatcagacgcagaatagagagcgacagcgattcgttgtcacgcacggtgccagtaccagaacaacgcggacaaacgtgatgactggattcacccagtgatgggctcaggcgctgacgggacatttccagcaggccaaagcgagaaatatggctgatttgaatacgcgcacggtcctgacgcaccgcttcacgcagacggttttctaccgcacgctggtggcgtactggcgtcatgtcgatgaagtcgataacaatcaggccgccgaggtcacgcaggcgcagctgacgagcaatctcatcggcagcttcgaggttagtgttaaacgcggtttcttcgatatcgccgccgcgggtcgcgcgtgcggagttgatgtcgatggccgttaacgcttcggtgctgtcgataacaatggaaccaccagacggcagacgaacttcacgctggaaggcggactcgatctgtgactcgatctggtagtggctgaacagcgggatctcgccggtgtacagtttgattttgctgctgaaatccgggcgacctaatgcagcgatatgctgacgtgccagttcgagcactttcgggttatcgataaggatttcgccgatgtcctgacgtaagtaatcgcggaatgcgcgaacgattacgttgctctcctgatgaatcaggaacggggccgggcggctttcagcggcttttttgatggcttcccagtgtttcagacggaagcttaaatcccattgcagcgcctcagcagatttgccgacgccagcggtgcgcacgataagccccatgccttccggcagttcaaggcttgccagtgcttcttttaattcggtacggtcgtcgccttcgatacggcgagaaatgccacccgcgcgcgggttgttcggcatcagaaccagatagctacccgccagactgataaaggtggttaatgccgcgcctttgttgccgcgctcttctttatcgatctgaacaatgacttcctgaccttcacgcaacacatctttaatgttgggacgaccatgagcactgtagttagcagggaaatattcgcgggcaatttcttttagtgggaggaaaccgtgacgttcagcgccgtaatcaacaaaagcagcttccagactcggttcaatgcgggtgattttacctttgtagatgtttgcctttttctgctcgtgccctggactttcgatatccaggtcatacagacgctgcccatctacaagggcaacgcgcaactcttcctgctgagttgcgttgattaacattcttttcatcgtaacttactcattattcttacattgacgactaagctgcgggcaaagtaacgcctttccgggtgtgaaccgatggcctcgtgtctagtcgcgtcgccaacctcacggttatcgtcagctcaaagaggcgcagagtgtcggttgcccgtttttcatgcggaaaaacagcgcaattatcaaagaaacagactgggtattactctccagaaatatttccatctaccggtaaggactgcaacccgcagcccgctaactgcctgaaagatcaatacgtcttacgccattgctgcgtggatgatcggtcgggcaaaatgggttattccgtaaaatttcttgttttaacaaggatggacacggaaacggcctcattattccactgcaagccttgttatagcaagatgacttttaccatttatcacccgcttactcacagttttttcacttcttgctggtgattggtttaataaccatcaataaagtgatcacgcagtgaagtaataaggtgcaaaagtaaatataagcatagaaaaatgagtggcgcgaatcctgttggctaattagaatcgccaaccatgaaaacagagactccatccgtaaaaattgttgctatcaccgctgacgaagcggggcaacgtatcgataactttttgcgtacccaattgaaaggcgtaccaaaaagtatgatttaccgtattttgcgtaaaggcgaagtgcgggtgaacaaaaaacgtattaagcctgaatataaactcgaagcgggtgatgaggtgcgtattccaccggttcgcgttgctgagcgggaagaagaggcggtttcgccacatctgcaaaaggtggcggcgctggcggacgtcatcttatatgaagatgatcacatcctggtgctgaataaaccttccggtacggcggtacatggcggcagtggtttaagcttcggcgttattgaaggtttgcgggcgttgcgcccggaagcgcggttccttgaactggttcatcgtcttgaccgggacacctcaggtgttttgctggtagcgaaaaaacgctcggcgttgcgttctctgcatgagcaattacgtgaaaaagggatgcaaaaagattacctggcgctggtgcgcggtcagtggcagtcgcatgtgaagagcgttcaagcaccgttactgaaaaatattctgcaaagcggcgaacgtatcgtgcgtgtgagtcaggaaggcaaaccgtcggaaacacgctttaaagtggaagaacgctatgcatttgccaccctggtgcgttgtagcccggtaacagggcgtactcaccagatccgtgtgcatacacaatatgcgggtcatccgattgcctttgacgatcgctacggtgaccgtgaatttgacaggcagctcactgaagcaggcacgggattaaatcgcctgttcctgcacgctgcagcgttgaagtttactcatccggggaccggtgaggtgatgcgtatcgaagctccgatggatgaaggtttgaagcgttgtttgcaaaagctgcgtaacgcgcgctaatacaagcatataaacctgataatgggcggttggcctgataaggcgtttacgccgcatcaggccgccagcaccgattgccggatgcgacgtaaccacatccggcgcaaaaaactatcccatcagcgggtttttcccttcccgacgtaacatctgacacagcgcgattagcggtaaaccaaccagcgtgttaggatcacgcccctctaaacgctcaaacagcgtaatgccaaatccttcactcttaaagctacccgcgcagtgcaggggatgctctttacgcacgtaattatcaatctccgcctcgctcaggtgacggaaatggacgtcaaaaggctccacttctgtttgcagatgcccattcgccgaattaaacaacgccagtccagtatagaaggtgacgatattgccgctggctttgcgtaattgcagacgggcattttcttccgttaacggtttaccggtgatttcgccatcaagaacacatacctggtctgaaccaataattaaatgatccggataacgtgacgccagagattgcgctttttcttgtgccagtcgaagcaccaactgtcgcggtgattcgtcgctgcgtggggtttcgtcgacctctggtgctgcacattcaaaagagatttgcagtttttccagaagagcgcgacgccatggcgaggtggaggctaaaataagtttaggcatatttttttccatcagatatagcgtattgatgatagccattttaaactatgcgcttcgttttgcaggttgatgtttgttatcagcactgaacgaaaataaagcagtaacccgcaatgtgtgcgaattattggcaaaaggcaaccacaggctgcctttttctttgactctatgacgttacaaagttaatatgcgcgccctatgcaaaaggtaaaattacccctgactctcgatccggttcgtacggctcaaaaacgccttgattaccagggtatctatacccctgatcaggttgagcgcgtcgccgaatccgtagtcagtgtggacagtgatgtggaatgctccatgtcgttcgctatcgataaccaacgtctcgcagtgttaaacggcgatgcgaaggtgacggtaacgctcgagtgtcagcgttgcgggaagccgtttactcatcaggtctacacaacgtattgttttagtcctgtgcgttcagacgaacaggctgaagcactgccggaagcgtatgaaccgattgaggttaacgaattcggtgaaatcgatctgcttgcaatggttgaagatgaaatcatcctcgccttgccggtagttccggtgcatgattctgaacactgtgaagtgtccgaagcggacatggtctttggtgaactgcctgaagaagcgcaaaagccaaacccatttgccgtattagccagcttaaagcgtaagtaattggtgctccccgttggatcggggataaaccgtaattgaggagtaaggtccatggccgtacaacagaataaaccaacccgttccaaacgtggcatgcgtcgttcccatgacgcgctgaccgcagtcaccagcctgtctgtagacaaaacttctggtgaaaaacacctgcgtcaccacatcactgccgacggttactaccgcggccgcaaggtcatcgctaagtaatcacgcatctgcgtgatgaagcttagtgaggattttccccaggcaactggggaaagaccaaaccgggcggcgacgataccttgacacgtctaaccctggcgttagatgtcatgggaggggattttggcccttccgtgacagtgcctgcagcattgcaggcactgaattctaattcgcaactcactcttcttttagtcggcaattccgacgccatcacgccattacttgctaaagctgactttgaacaacgttcgcgtctgcagattattcctgcgcagtcagttatcgccagtgatgcccggccttcgcaagctatccgcgccagtcgtgggagttcaatgcgcgtggccctggagctggtgaaagaaggtcgagcgcaagcctgtgtcagtgccggtaataccggggcgctgatggggctggcaaaattattactcaagcccctggaggggattgagcgtccggcgctggtgacggtattaccacatcagcaaaagggcaaaacggtggtccttgacttaggggccaacgtcgattgtgacagcacaatgctggtgcaatttgccattatgggctcagttctggctgaagaggtggtggaaattcccaatcctcgcgtggcgttgctcaatattggtgaagaagaagtaaagggtctcgacagtattcgggatgcctcagcggtgcttaaaacaatcccttctatcaattatatcggctatcttgaagccaatgagttgttaactggcaagacagatgtgctggtttgtgacggctttacaggaaatgtcacattaaagacgatggaaggtgttgtcaggatgttcctttctctgctgaaatctcagggtgaagggaaaaaacggtcgtggtggctactgttattaaagcgttggctacaaaagagcctgacgaggcgattcagtcacctcaaccccgaccagtataacggcgcctgtctgttaggattgcgcggcacggtgataaaaagtcatggtgcagccaatcagcgagcttttgcggtcgcgattgaacaggcagtgcaggcggtgcagcgacaagttcctcagcgaattgccgctcgcctggaatctgtatacccagctggttttgagctgctggacggtggcaaaagcggaactctgcggtagcaggacgctgccagcgaactcgcagtttgcaagtgacggtatataaccgaaaagtgactgagcgtacatgtatacgaagattattggtactggcagctatctgcccgaacaagtgcggacaaacgccgatttggaaaaaatggtggacacctctgacgagtggattgtcactcgtaccggtatccgcgaacgccacattgccgcgccaaacgaaaccgtttcaaccatgggctttgaagcggcgacacgcgcaattgagatggcgggcattgagaaagaccagattggcctgatcgttgtggcaacgacttctgctacgcacgctttcccgagcgcagcttgtcagattcaaagcatgttgggcattaaaggttgcccggcatttgacgttgcagcagcctgcgcaggtttcacctatgcattaagcgtagccgatcaatacgtgaaatctggggcggtgaagtatgctctggtcgtcggttccgatgtactggcgcgcacctgcgatccaaccgatcgtgggactattattatttttggcgatggcgcgggcgctgcggtgctggctgcctctgaagagccgggaatcatttccacccatctgcatgccgacggtagttatggtgaattgctgacgctgccaaacgccgaccgcgtgaatccagagaattcaattcatctgacgatggcgggcaacgaagtcttcaaggttgcggtaacggaactggcgcacatcgttgatgagacgctggcggcgaataatcttgaccgttctcaactggactggctggttccgcatcaggctaacctgcgtattatcagtgcaacggcgaaaaaactcggtatgtctatggataatgtcgtggtgacgctggatcgccacggtaatacctctgcggcctctgtcccgtgcgcgctggatgaagctgtacgcgacgggcgcattaagccggggcagttggttctgcttgaagcctttggcggtggattcacctggggctccgcgctggttcgtttctaggataaggattaaaacatgacgcaatttgcatttgtgttccctggacagggttctcaaaccgttggaatgctggctgatatggcggcgagctatccaattgtcgaagaaacgtttgctgaagcttctgcggcgctgggctacgacctgtgggcgctgacccagcaggggccagctgaagaactgaataaaacctggcaaactcagcctgcgctgttgactgcatctgttgcgctgtatcgcgtatggcagcagcagggcggtaaagcaccggcaatgatggccggtcacagcctgggggaatactccgcgctggtttgcgctggtgtgattgatttcgctgatgcggtgcgtctggttgagatgcgcggcaagttcatgcaagaagccgtaccggaaggcacgggcgctatggcggcaatcatcggtctggatgatgcgtctattgcgaaagcgtgtgaagaagctgcagaaggtcaggtcgtttctccggtaaactttaactctccgggacaggtggttattgccggtcataaagaagcggttgagcgtgctggcgctgcctgtaaagcggcgggcgcaaaacgcgcgctgccgttaccagtgagcgtaccgtctcactgtgcgctgatgaaaccagcagccgacaaactggcagtagaattagcgaaaatcacctttaacgcaccaacagttcctgttgtgaataacgttgatgtgaaatgcgaaaccaatggtgatgccatccgtgacgcactggtacgtcagttgtataacccggttcagtggacgaagtctgttgagtacatggcagcgcaaggcgtagaacatctctatgaagtcggcccgggcaaagtgcttactggcctgacgaaacgcattgtcgacaccctgaccgcctcggcgctgaacgaaccttcagcgatggcagcggcgctcgagctttaaaagaggaaaatcatgaattttgaaggaaaaatcgcactggtaaccggtgcaagccgcggaattggccgcgcaattgctgaaacgctcgcagcccgtggcgcgaaagttattggcactgcgaccagtgaaaatggcgctcaggcgatcagtgattatttaggtgccaacggcaaaggtctgatgttgaatgtgaccgacccggcatctatcgaatctgttctggaaaaaattcgcgcagaatttggtgaagtggatatcctggtcaataatgccggtatcactcgtgataacctgttaatgcgaatgaaagatgaagagtggaacgatattatcgaaaccaacctttcatctgttttccgtctgtcaaaagcggtaatgcgcgctatgatgaaaaagcgtcatggtcgtattatcactatcggttctgtggttggtaccatgggaaatggcggtcaggccaactacgctgcggcgaaagcgggcttgatcggcttcagtaaatcactggcgcgcgaagttgcgtcacgcggtattactgtaaacgttgttgctccgggctttattgaaacggacatgacacgtgcgctgagcgatgaccagcgtgcgggtatcctggcgcaggttcctgcgggtcgcctcggcggcgcacaggaaatcgccaacgcggttgcattcctggcatccgacgaagcagcttacatcacgggtgaaactttgcatgtgaacggcgggatgtacatggtctgaccgcgatttgcacaaaatgctcatgttgcgcgcagtctgcgtggttatgagtaataattagtgcaaaatgatttgcgttattggggggtaaggcctcaaaataacgtaaaatcgtggtaagacctgccgggatttagttgcaaatttttcaacattttatacactacgaaaaccatcgcgaaagcgagttttgataggaaatttaagagtatgagcactatcgaagaacgcgttaagaaaattatcggcgaacagctgggcgttaagcaggaagaagttaccaacaatgcttctttcgttgaagacctgggcgcggattctcttgacaccgttgagctggtaatggctctggaagaagagtttgatactgagattccggacgaagaagctgagaaaatcaccaccgttcaggctgccattgattacatcaacggccaccaggcgtaagtgaacatctccaggcggtcgttcgaccgcctgagttttatctttttgtcccactagaatcattttttccctccctggaggacaaacgtgtctaagcgtcgtgtagttgtgaccggactgggcatgttgtctcctgtcggcaataccgtagagtctacctggaaagctctgcttgccggtcagagtggcatcagcctaatcgaccatttcgatactagcgcctatgcaacgaaatttgctggcttagtaaaggattttaactgtgaggacattatctcgcgcaaagaacagcgcaagatggatgccttcattcaatatggaattgtcgctggcgttcaggccatgcaggattctggccttgaaataacggaagagaacgcaacccgcattggtgccgcaattggctccgggattggcggcctcggactgatcgaagaaaaccacacatctctgatgaacggtggtccacgtaagatcagcccattcttcgttccgtcaacgattgtgaacatggtggcaggtcatctgactatcatgtatggcctgcgtggcccgagcatctctatcgcgactgcctgtacttccggcgtgcacaacattggccatgctgcgcgtattatcgcgtatggcgatgctgacgtgatggttgcaggtggcgcagagaaagccagtacgccgctgggcgttggtggttttggcgcggcacgtgcattatctacccgcaatgataacccgcaagcggcgagccgcccgtgggataaagagcgtgatggtttcgtactgggcgatggtgccggtatgctggtacttgaagagtacgaacacgcgaaaaaacgcggtgcgaaaatttacgctgaactcgtcggctttggtatgagcagcgatgcttatcatatgacgtcaccgccagaaaatggcgcaggcgcagctctggcgatggcaaatgctctgcgtgatgcaggcattgaagcgagtcagattggctacgttaacgcgcacggtacttctacgccggctggcgataaagctgaagcgcaggcggtgaaaaccatcttcggtgaagctgcaagccgtgtgttggtaagctccacgaaatctatgaccggtcacctgttaggtgcggcgggtgcagtagaatctatctactccatcctggcgctgcgcgatcaggctgttccgccaaccatcaacctggataacccggatgaaggttgcgatctggatttcgtaccgcacgaagcgcgtcaggttagcggaatggaatacactctgtgtaactccttcggcttcggtggcactaatggttctttgatctttaaaaagatctaagttgtcattttccacccttataaaaggtccgcttgcgggccttttttcttagcttttattccgacttgttccgtagtgaacatgctgccacactaacaattctctgataaggagccggtatgttcttaattaacggtcataagcaggaatcgctggcagtaagcgatcgggcaacgcagtttggtgatggttgttttaccaccgccagagttatcgacggtaaagtcagtttgttatcggcgcatatccagcgactacaggatgcttgtcagcggttgatgatttcctgtgacttctggcctcagcttgaacaagagatgaaaacgctggcagcagaacagcaaaatggtgtgctgaaagtcgtgatcagtcgcggtagtggcgggcgagggtacagcacattgaacagcggaccggcaacgcggattctctccgttacggcttatcctgcacattacgaccgtttgcgtaacgaggggattacgttggcgctaagcccggtgcggctggggcgcaatcctcatcttgcaggtattaaacatctcaatcgtcttgagcaagtattgattcgctctcatcttgagcagacaaacgctgatgaggcgctggtccttgacagcgaagggtgggttacggaatgctgtgcggctaatttgttctggcggaagggcaacgtagtttatacgccgcgactggatcaggcaggtgttaacggcattatgcgacaattctgtatccgtttgctggcacaatcctcttatcagcttgtcgaagtgcaagcctctctggaagagtcgttgcaggcagatgagatggttatttgtaatgcgttaatgccagtgatgcccgtatgtgcctgtggcgatgtctccttttcgtcagcaacgttatatgaatatttagccccactttgtgagcgcccgaattagtcatgaaaaaagtgttattgataatcttgttattgctggtggtactgggtatcgccgctggtgtgggcgtctggaaggttcgccatcttgccgacagcaaattgcttatcaaagaagagacgatatttaccctgaagccagggaccggacgtctggcgctcggtgaacagctttatgccgataagatcatcaatcgtccacgggtttttcaatggctgctgcgtatcgaaccggatctttctcactttaaagccgggacttaccgctttacaccgcagatgaccgtgcgcgagatgctgaaattgctggaaagcggtaaagaagcacagttccctctgcgactggtagaagggatgcgtctgagcgattacctcaagcaattgcgtgaggccccgtatatcaagcatacgctgagcgatgataagtacgccaccgtagcgcaggcacttgaactggaaaacccggagtggattgaaggttggttctggccagacacctggatgtataccgccaataccaccgatgtcgcgttactcaagcgagcgcacaagaaaatggtgaaagcggtcgatagcgcctgggaagggcgtgcggacggtctgccttataaagataaaaaccagttggtgacgatggcatcaattatcgaaaaagaaaccgccgttgccagtgaacgcgataaggttgcctcagtatttatcaaccgtttacgcattggtatgcgcctgcagaccgacccgaccgtgatttacgggatgggagagcgttataatggcaaactttctcgtgcagacctggaaacgccgacagcgtataacacctataccattaccggtctgccgccaggtgcgatagcgacgccgggggcggattcgctgaaggctgctgcgcatccggcaaaaacgccgtatctctattttgtggccgatggtaaaggtggtcacacgtttaataccaatcttgccagtcataacaagtctgtgcaggattatctgaaagtgcttaaggaaaaaaatgcgcagtaagtatatcgtcattgaggggctggaaggcgcaggcaaaactaccgcgcgtaatgtggtggttgagacgctcgagcaactgggtatccgcgacatggttttcactcgggaacctggcggtacgcaacttgccgaaaagttaagaagcctggtgctggatatcaaatcggtaggcgatgaagtcattaccgataaagccgaagttctgatgttttatgccgcgcgcgttcaactggtagaaacggtcatcaaaccagctctggctaacggcacctgggtgattggcgatcgccacgatctctccactcaggcgtatcagggcggcggacgtggtattgaccaacatatgctggcaacactgcgtgatgctgttctcggggattttcgccccgacttaacgctctatctcgatgttaccccggaagttggcttaaaacgcgcgcgtgcgcgcggcgagctggatcgtattgagcaagaatctttcgatttctttaatcgcacccgcgcccgctatctggaactggcagcacaagataaaagcattcataccattgatgccacccagccgctggaggccgtgatggatgcaatccgcactaccgtgacccactgggtgaaggagttggacgcatgagatggtatccatggttacgacctgatttcgaaaaactggtagccagctatcaggccggaagaggtcaccatgcgctactcattcaggcgttaccgggcatgggcgatgatgctttaatctacgccctgagccgttatttactctgccaacaaccgcagggccacaaaagttgcggtcactgtcgtggatgtcagttgatgcaggctggcacgcatcccgattactacaccctggctcccgaaaaaggaaaaaatacgctgggcgttgatgcggtacgtgaggtcaccgaaaagctgaatgagcacgcacgcttaggtggtgcgaaagtcgtttgggtaaccgatgctgccttactaaccgacgccgcggctaacgcattgctgaaaacgcttgaagagccaccagcagaaacttggtttttcctggctacccgcgagcctgaacgtttactggcaacattacgtagtcgttgtcggttacattaccttgcgccgccgccggaacagtacgccgtgacctggctttcacgcgaagtgacaatgtcacaggatgcattacttgccgcattgcgcttaagcgccggttcgcctggcgcggcactggcgttgtttcagggagataactggcaggctcgtgaaacattgtgtcaggcgttggcatatagcgtgccatcgggcgactggtattcgctgctagcggcccttaatcatgaacaagctccggcgcgtttacactggctggcaacgttgctgatggatgcgctaaaacgccatcatggtgctgcgcaggtgaccaatgttgatgtgccgggcctggtcgccgaactggcaaaccatctttctccctcgcgcctgcaggctatactgggggatgtttgccacattcgtgaacagttaatgtctgttacaggcatcaaccgcgagcttctcatcaccgatcttttactgcgtattgagcattacctgcaaccgggcgttgtgctaccggttcctcatctttaagagagacatcatgtttttagtcgactcacactgccatctcgatggtctggattatgaatctttgcataaggacgtggatgacgttctggcgaaagccgccgcacgcgatgtgaaattttgtctggcagtcgccacaacattaccgggttatttacatatgcgggatctggtaggcgaacgtgacaacgtcgtattttcttgtggcgtgcatccactcaaccagaatgatccctacgatgtagaagatttacgccgtctggcggcagaagagggtgttgtagcgctgggtgaaaccgggctggattattattacacgccggaaactaaagtacgtcagcaagagtccttcatccatcatatccagattggtcgtgaactgaacaagccggttatcgtccatacccgtgacgcccgtgccgatacgctggcaattctgcgcgaagaaaaagtgacggattgcggtggcgtactacactgttttacagaggacagagaaacggcgggtaaattactggatctcggattttacatctccttttccggcattgtgaccttccgtaatgcggagcaactgcgcgatgctgcgcgttatgtccccctggatcggttactggtggaaactgactcaccttaccttgcgccggtaccgcatcgaggaaaagagaatcaacctgcgatggttcgtgacgttgcagaatacatggctgtgttgaaaggtgttgccgttgaagaactggcgcaggtaaccaccgataacttcgcccgtctgtttcacatcgacgcttcccgccttcaatccatccgttgaatgagtttttttaaagctcgtaattaatggctaaaacgagtaaagttcaccgccgaaaattgggcggtgaataaccacgtttgaaatattgtgacatatgttttgtcaaaatgtgcaacttctccaatgatctgaagttgaaacgtgatagccgtcaaacaaattggcactgaattattttactctgtgtaataaataaagggcgcttagatgccctgtacacggcgaggctctccccccttgccacgcgtgagaacgtaaaaaaagcacccatactcaggagcactctcaattatgtttaagaatgcatttgctaacctgcaaaaggtcggtaaatcgctgatgctgccggtatccgtactgcctatcgcaggtattctgctgggcgtcggttccgcgaatttcagctggctgcccgccgttgtatcgcatgttatggcagaagcaggcggttccgtctttgcaaacatgccactgatttttgcgatcggtgtcgccctcggctttaccaataacgatggcgtatccgcgctggccgcagttgttgcctatggcatcatggttaaaaccatggccgtggttgcgccactggtactgcatttacctgctgaagaaatcgcctctaaacacctggcggatactggcgtactcggagggattatctccggtgcgatcgcagcgtacatgtttaaccgtttctaccgtattaagctgcctgagtatcttggcttctttgccggtaaacgctttgtgccgatcatttctggcctggctgccatctttactggcgttgtgctgtccttcatttggccgccgattggttctgcaatccagaccttctctcagtgggctgcttaccagaacccggtagttgcgtttggcatttacggtttcatcgaacgttgcctggtaccgtttggtctgcaccacatctggaacgtacctttccagatgcagattggtgaatacaccaacgcagcaggtcaggttttccacggcgacattccgcgttatatggcgggtgacccgactgcgggtaaactgtctggtggcttcctgttcaaaatgtacggtctgccagctgccgcaattgctatctggcactctgctaaaccagaaaaccgcgcgaaagtgggcggtattatgatctccgcggcgctgacctcgttcctgaccggtatcaccgagccgatcgagttctccttcatgttcgttgcgccgatcctgtacatcatccacgcgattctggcaggcctggcattcccaatctgtattcttctggggatgcgtgacggtacgtcgttctcgcacggtctgatcgacttcatcgttctgtctggtaacagcagcaaactgtggctgttcccgatcgtcggtatcggttatgcgattgtttactacaccatcttccgcgtgctgattaaagcactggatctgaaaacgccgggtcgtgaagacgcgactgaagatgcaaaagcgacaggtaccagcgaaatggcaccggctctggttgctgcatttggtggtaaagaaaacattactaacctcgacgcatgtattacccgtctgcgcgtcagcgttgctgatgtgtctaaagtggatcaggccggcctgaagaaactgggcgcagcgggcgtagtggttgctggttctggtgttcaggcgattttcggtactaaatccgataacctgaaaaccgagatggatgagtacatccgtaaccactaatccgtaagacgttggggagactaaggcagccagatggctgccttttttacaggtgttattcagaattgatacgtgccggtaatgctgaaattacgcggtgtgccgtagacgatagaaccttccacgttggtatcgtaggttttgtcgaacaggttattgacgttcccctgtaacgagaagtttttcgtcacctggtagcgggtgaagagatccaccagcgcgtagctaccttgctcggcgcggaaggtgccatacggcgtcacggtgtcggtatacacgcgattttgccagttaacaccaccgccgaccgtcaactctggcatgacaggcaaccgatagctggtgaacattttaaccgtggtgcgtggcagattaggattaacggcgtttccttcgttatcctctgcaatatagcgcgttgcgccaaatgtcagctgccagttgtcggtaattgcgccgttgagttcaaattccacccctttactgactgtcccatccaccgctttataggcggtttcgccgttgctgccggggataggtgtaccggtggactgagcgacattatcctgctcaatacggaagatggctaacgtggtggtcagacggctattcatccagtccgatttcagacccagctcgtagttgttaccggtgattggagccagatatttgcctgaactgtcacgatcattttgcggctggaaaatagaggtatagctggcgtaggtcgaccagttgtcattgatgtcaaacaccagaccagcgtaaggcgtggtgtggtttttctccatgctgtaagtcagcgtatcaacccgccagttggtataacgtgcgccgaggatcagatgcagcggatcggcaagggtgacacgagtggcagcatataacgatttcatatgtgtggtatcgtcctgcgccaggctctgtggtgaccagtcggtttgtgggaaattgccattaaagttgtagaaactgccaatttcatccgggaagatgttggcccatgaactgaagtaacgattgttttgtttgctgtaactgccaccaaacattagattgtgctgacgaccaaacaattcataactaccgtcagcgaacaaatccagcgcatcaactttacgtttgccactgttccaaccggtgccgccgacataatcaaagccaggtccataattactgtatggcccaaccagcataccatccgctttgtttacataggcatcgacatacatcattttgctgtcaaattcgacttcagagtgggtggcattcagtgtcgcttgccaggtatcagcaaactgctgcttcagggtcataaagaccttgttgatctctttatcgttgtacgcccagtcaggtgcggtactgcgtgcgcgatcgtaactgttgctgctgccatcagtattccagcgcggtaaaccgccccaggtagggctattaacatcaatgcgctgatattcgtaaccggctgaaagcgtcgtaagatcgcctaaatcagcatcgacaatgcccgagaagaaggtcttttcactgttgtagcggtccagccatgagtcgttattctggtagccgccgacaattcgcgcgcggattttaccgtcttcggtgagtgggctttgtaaatccgccacataccgttctttgttccagctaccgtattccgccgagacatcgcctttaaattcacgactggtcgcgtgttttcgaaccatattaattgccgcagatggattacccgtcccggtcatgagtcctgtcgcgccacgcactacttctacgcgttcaaagagtgccatatcagaaagtgcgtcgcccagattccagcgcgattcaaaataggtggggataccatcaaccatatagttatcgatctggaatccgcgggaataataaagagcacgatcggaatccgcctgacttttgctgatccccagcgtgttttccatcacttcgcccagcgtttgtaactgctgatcttccatccgctgctggctaacaatagtgaccgactgaggaatatcacgttgagtcatctgcattttggtacccgcagaggtagacgttacgctgtaatcattttcgccatcatctggagctgtggctgaaccctcaacaatcaccgtttcttcagtggctggtgcagcaaaagcggcagaaggtaatagtgccagtgctatgcaaccggcaagtagtgacggtttggtgatggcttgatattgattatccctgttaaattgtgttgaaagcatttgaaatctcttggtttatgttgtcgtcaggctcatgccggaggagggtgatgagcgattatatttagtgtgcgaataattttgtttgtaaatgcaaatgagaaatatacgcattcatatttgtcatgtaaaccaaacagagaatgtcttttcagcgcattcgcaggcagaaatgggaataatggcgatatatacggcagcaaaacgattttttgcttaagaaatcgtgagttaaggttgaaagagcaggtttaactcgaccatactctatactcgcagtgtggcgcggcgtagcatggcgcaacgcatggctatttgaaaaaggaaaatgtcgtggcagaagaaactatattcagcaaaattattcgtcgtgagatcccctccgatatcgtctaccaggatgatctggtaacggcgtttcgcgatatttcgccgcaagcgccaacgcatattctgatcattccgaatatcctcattccgactgtgaacgacgtctcagctgagcatgagcaggcgctgggacgcatgatcaccgtagcggcaaaaattgctgagcaagaaggtattgccgaagatggctatcgtctgatcatgaataccaaccgccatggcggacaagaggtttaccacatccatatgcacttgttgggtggccgtccgctgggaccaatgctggcgcataaaggtctgtaacgatgagaaaaggatgctttgggctggtgtctctggtgttgttactgctggtgggctgtcgttcacatccggaaattccggtgaatgatgagcaatcgctggtgatggagtcatctttattggctgcgggcatcagtgcagaaaagcccttcctttcgacgtctgatattcaaccttcagcatcctcaacgctttataacgaaaggcaagaacccgttaccgttcattatcgtttttactggtatgacgccagagggctggagatgcatcctctggaaaggccacgcagcgttaccattcccgcacattcggcggtaacgctgtacggcagcgccaattttctgggggcgcacaaagtcagactttatctatatttgtaaggggtgaatcttgatgacaaaaatgagtcgctacgccttgattaccgcgctggcgatgtttctcgccgggtgtgtggggcaacgtgaacctgcaccggtagaagaagtgaaaccagcgccggaacaaccagccgagccacaacagcctgtccccacagtgccctcggtgccgacgatcccgcagcagccaggcccaattgagcacgaagatcaaactgcaccgcctgcgccgcatattcgccattatgactggaatggcgcaatgcagccgatggtcagtaagatgcttggggctgacggggtgactgcgggtagcgtcctgctggttgatagcgttaacaaccgtactaacggttcgctgaatgccgcagaagcgaccgaaacgctgcgaaatgcgctggctaataacgggaaatttaccctggtttccgcccagcaactgtcgatggcgaagcaacagttaggtttgtcgccgcaggacagtttaggcacccgtagtaaagccataggcattgcccgcaatgtcggcgctcattacgtgctgtactccagcgcctctggcaacgttaacgctccgaccctacaaatgcagctgatgctggtgcagacgggcgaaattatctggtcaggtaaaggtgccgtttcgcagcaataatcccatcacgcgcgacgaattgctgtcgcgctttttcccgcagtatcatcccgtcacgacgtttaatagtgggcttagtggcgggagttttctcattgaacatcagggccagcgttttgttgtgcgtcagccgcacgatcctgatgcgccgcagtccgcgttcttgcgccagtatcgggctttatcacaactacccgcatgcattgcaccgaagccgcatttatatctccgtgactggatggtagtcgactatctgcccggcgcggtaaaaacgtatttgccggataccaacgaactggcaggcttgctgtattatctacatcaacaaccacgttttggctggcgaataacgctgttgccgttactggaactgtactggcagcaaagcgatccggcgcggcggacagtgggttggctgcgaatgttaaaacgtctgcgcaaagcgcgggaaccacggcctttacgcttaagtccattgcatatggatgtccacgccggaaatttagtgcatagcgcgtcagggttaaaactcatcgactgggagtatgccggagatggtgatatcgcgctggaactggcggcggtgtgggtggaaaatactgaacagcaccggcaattggtcaatgactatgccactcgcgcgaagatttatccggcgcaattatggcgtcaggtcaggcgatggtttccctggctgctgatgctcaaagcagggtggtttgagtaccgctggcgacaaaccggcgatcaacaatttatcaggctggccgatgacacctggcggcagctattaataaaacaataaggagagcagtgtgggtccagtaatgttggatgtcgaaggttacgaactggacgcggaagagcgtgaaatactggcgcatccgctggtgggagggctgattctctttacgcgtaactatcatgatcctgcccagttacgtgaactggtgcgccagatccgcgcagcttcgcgcaatcgtctggtggtggcggttgatcaggaaggtggacgcgtgcagcgttttcgtgaaggttttacccgcttgccagcggcgcaatcattcgctgcgctgtcaggaatggaagagggtggcaaactggcgcaggaggcaggttggttgatggccagcgaaatgatcgctatggatattgatatcagctttgcgcctgtgctggatgtcgggcatatcagcgcggcgattggcgagcgttcttatcatgccgatccacaaaaagccctggcaattgccagccggtttattgatggtatgcatgaagccggaatgaaaacgaccgggaaacacttcccaggacacggtgcagtaacggcagactcacacaaagaaacaccgtgcgatccacgtccacaagcggagattcgcgctaaagatatgtcggtcttcagttccttaatccgcgaaaataaactcgacgccattatgcctgcgcatgtgatctacagtgatgttgatccgcgtccggcgagcggttctccctactggctgaaaaccgttttgcgtcaggaactgggttttgacggcgtgattttctctgacgatttatcgatggaaggtgccgcgattatgggcagttatgccgaacgcgggcaggcttcactggatgcgggttgcgatatgatcctggtctgcaataatcgtaaaggggccgtcagcgtgttagataatctgtcaccgatcaaggcagaacgtgttacacgtttgtatcataaaggttcattttcgcgacaggaactgatggactcggctcgctggaaagcgatcagcacccgtctgaatcagttacatgaacgctggcaggaagagaaagcaggtcactaaccctggcttatgtgaggaagcgatgattatctatttacacggttttgactctaacagtccgggtaaccacgagaaagtcttacaattgcagtttattgacccggatgtacgcttgataagctacagtacgcggcatccgaaacatgatatgcagcatctgcttaaagaagtggacaaaatgttgcaactgaacgttgacgagcgtccgctaatttgcggcgttggcttgggcggatactgggcggaacggattggttttctttgcgacatccgccaggtgatcttcaaccctaatttgttcccttatgagaacatggaaggcaagattgatcgcccggaagagtatgccgatattgccactaagtgtgtgaccaacttccgtgagaagaatcgcgatcgttgcctggtgattttgtcgcgtaatgatgaagcgcttaacagccagcggacatctgaagagttgcatcattattacgagattgtctgggacgaagagcagacgcacaaattcaagaatatctccccgcatttacagcgcattaaagcgttcaaaaccctcgggtaaatgccctcgtcgcatcaggtaaccttgccggtacctgatgcgctccgaattctgtgggtcggataaggcgtccacgccgcatccgacagtcgagcatcaatgcctgatgcgcttcttatcaggcctaccgaacgccctgcatacacccctcactctatatcactctcacaaattcgctcaaataataaacaataaactctgttttttgatctcacccggtaaagtcgcctatcttttcagcaacaaaacttgattaacatcaattttggtatgaccaatgcaccattcatgttattctcaatagcgaagaacattttcattgctgtaacctgttgttaattaagagctatgttaataaccattaattaacaattggttaataaatttaagggggtcacgttgactacgccattgaaaaagattgtgattgtcggcggcggtgctggtgggctggaaatggcaacacagctggggcataagctgggacgcaagaaaaaagccaaaattacgctggtcgatcgtaaccacagccacctgtggaaaccgctgctgcacgaagtggcgactggctcgcttgatgaaggcgtcgatgcgttgagctatctggcccatgcgcgcaatcatggtttccagttccagctgggttccgtcattgatattgatcgtgaagcgaaaacaatcactattgcagaactgcgcgacgagaaaggtgaactgctggttccggaacgtaaaatcgcctatgacaccctggtaatggcgctgggtagcacctctaacgatttcaatacgccaggtgtcaaagagaactgcattttcctcgataacccgcaccaggcgcgtcgcttccaccaggagatgctgaatttgttcctgaaatactccgccaacctgggcgcgaatggcaaagtgaacattgcgattgtcggcggcggcgcgacgggtgtagaactctccgctgaattgcacaacgcggtcaagcaactgcacagctacggttacaaaggcctgaccaacgaagccctgaacgtaacgctggtagaagcgggagaacgtattttgcctgcgttaccgccacgtatctctgctgcggcccacaacgagctaacgaaacttggcgttcgcgtgctgacgcaaaccatggtcaccagtgctgatgaaggcggcctgcacactaaagatggcgaatatattgaggctgatctgatggtatgggcagccgggatcaaagcgccagacttcctgaaagatatcggtggtcttgaaactaaccgtatcaaccagctggtggtggaaccgacgctgcaaaccacccgcgatccagacatttacgctattggcgactgcgcgtcatgcccgcgtccggaagggggctttgttccgccgcgtgctcaggctgcacaccagatggcgacttgcgcaatgaacaacattctggcgcagatgaacggtaagccgctgaaaaattatcagtataaagatcatggttcgctggtatcgctgtcgaacttctccaccgtcggtagcctgatgggtaacctgacgcgcggctcaatgatgattgaaggacgaattgcgcgctttgtatatatctcgctataccgaatgcatcagattgcgctgcatggttactttaaaaccggattaatgatgctggtggggagtattaaccgcgttatccgtccgcgtttgaagttgcattaatcgacgtacactggcggatgtggcataaacgcctcatccgcccttgaggaacagcgcgatcggcagccgcgttgtatcaggcatcctttcagactcctccgaatccttaagtatttccagccattcccgcgcttttcatcttctgtctgatagctgcttttctccttcgcttgcatgattggcataactgcaaagaaggaggtgttcccgtgaataaatcaatgttggcgggtatcgggattggtgtcgcagctgcgctgggcgtagcggcagtggccagtctgaacgtgtttgaacggggcccgcaatacgctcaggttgtttctgcaaccccaatcaaggaaacggttaaaacaccgcgtcaggagtgtcgcaacgtcacagtgacccatcgtcgaccggtgcaggatgaaaatcgcattaccgggtcggtgctcggcgctgttgctggcggcgtgatagggcatcagtttggtggtggtcgcggtaaagatgtcgccactgttgtgggggcgctgggtggtggatatgccggtaaccagatccagggctctctccaggaaagcgatacttacacgactacgcaacagcgttgtaaaacggtgtatgacaagtcagaaaaaatgctcggttatgatgtgacctataagattggcgatcagcagggcaaaatccgcatggaccgcgatccgggtacgcagatcccgctagatagcaacgggcaactgattttgaataacaaagtataacaaggctgtactctgcaatttggcccctcattcgctcaggctgaggggctttttttgcgacttatttcaccagttcgggccataaacgcaaagtcgttccggcaatctgcatcagtttttccagcgatgcaccttcgcgtgcgctgatcgacatcccctgaataatacaattaaggaattctgccagatgtgtcacgtcacagtggggcgggatttccccgcgcgcttgtcgttgacataaaaactgctgcaaagtgcgctcttgcatcgcatggcgtgatttcaacgtattggcgatatctcctgaatctggggagagggtggtgcagttgttgatcatgaagcagcctgccggggtgtctttgctggtaaagcagttggcgatggcagcaaaatagtcagccagcgcagactccacgcttttctcttcacaaaacagctgtgcttcatgcttagcggcaaaacgatcgatatagcggtcgagaacggcacgaaataacccctctttgttggtaaattccgcgtatagcgtgggcgctttggctccggtcgcttcgacgaggtccgcaagagaagtcgcttcataaccgtgttgccagaacaatttcatggccttatcaagcgcggcatccctgtcgaacacttttgggcggccacggcttttttttacacattgtgttgagtcagttgccatgatgccgttgtacctggtgactgtgaatgaaaggttattataaaaataatcacctccgttcaccagtccagatcccataaaaataattgctttctatttaactgaaatttaaagatttttaaattaattaatgattgttataaaaaatatcttgtatgtgatccagatcacatctatcatttagttatcgatcgttaagtaattgcttgcgacgtcattcatctgcataaggccactattatgaaaaacgtaaaaaccctcatcgctgcggcgattttaagctccatgtcatttgccagctttgcggctgtcgaagttcagtcaacgccagaaggccaacaaaaagtcggtacaatcagtgctaacgcggggacaaatctgggatcgctggaagagcagctggcgcaaaaagcggatgagatgggcgcaaaatctttccgtattacttctgtaaccggtccgaataccctccatggaacagcagtaatttataaataagcattaaccctcattaatgcctgctactgctgattttttccccgcgacatgccgtgtcgcggggatttttttatccgggctttacagcgtttgtgggctcacttgatgacggcggacatccaccggcatcccggaacggacatccatcacatgttgcatcacttcagcgtcagtttgtgctgcatctttaaatgattgcattgcgctattcagcgtaattggcagcagctgcggatcgtcatcaatcttctctgacagcggctgatgtacttcaaccagacgcgcaccgtttggttcggcagagacttttatcggagtgttgatgatattcactttggtgcctggggtgacctggctaaagagtgttttgatatcgtcatcccgcagacgaatacagccagaacttacccgcatgccaatgccgaaatcggcgttcgtaccatgaagcaaataaacgccgccataggccgccagacgaatcgcatgatggcccattgggttatccagtccagccggcactaccgcaggcaactcaattccctgtgctttataacgggcgcggatgtttgccgttggcgtccaggttgggtttgcacgtttgtctgaaacggtggtcaccattgtcggtgtcagcgtgtcaccacctaactgaccaatacctattggatacacggttaccgaatttttacccggcgggtagtaatagagacgcagctccgcaatgttgatcacaatgccttcgcgcggcgcatctggaagtagggtttgcaacgggatcgttaacacgctgcccgcgcgcggtacgtaaggatcaacgccggggttagcctgtaacagagcgagaaagccgacgttgtattttttggcgatggcttccagagaaccaccgtcattttccaccacatgaaatttgttttcgccaaccagacgactgcccgctggcggcagcggccaggtgttggcttttgccggtagcgccagcgccacggcagcggcgaacgtaaaaaacgttagccagcgagaaaaacgcgttttgatcatcaccaaaaatccataataaatataaggttattgtaataaacagataagcctgaattatggatggtgacagtgtcggatagtgcagggaagtgcaaagaatttgtaaatgttgcagatgggggcgcagaaacgcccccgatttaccattaagcgatcgcgttctcttccagttcacgcataaactggcgtacccattcgatacgcgttttccgctcactcaaatcctgaataaatttcaggcgcgtcggaccatcaaggcggtaatgctgcggctgtttttgcagcaaaccaatcaaccaggccggattaacgtgattcttctcggcaaattcgatcaccccgcctttctcattaccttccagcttcctgatccccagtttctgcgcttgctggcgcagacgggcaatatccagcagggtacgcgccggatctggcagcaggccgaagcgatcgataagctcgactttgatctcttccagttcgttttccgttttggcgctggcaatacgtttgtagaacgacagacgcgtgttcacgtcagggatgaaatcatctggcaatagcgacggcatccgcagctcgacttctgtttgctggctggtgagatcttccagcgacggctcgcgtccggctttcagtgcatcgacggcgttttccagcaactccatatacagcgagaaaccgatggtttccattgagccgctttgttcttcgccaagcagttcacccgcgccgcgaatctccagatcgtgcgttgccagcgcaaaacctgccccgagatcttccagcgaggcaattgcttcaagacgtttttgtgcatcggtagtcatcgcttttggatgcggtgtcagcaaccatgcatatgcctgatgatgcgaacgtccgacgcgaccgcgtaactggtgcagctgcgccagaccgaagtgatccgcgcgttcaatgataatagtgttggctgtcgggatgtcgatcccggtttcgataatggttgtacaaaccagcacgttgaaacgttgatgatggaaatcattcatcacccgttccagttcgcgctcgcgcatctgcccgtgaccgatggcgatccgcgcttctggcaccagttctgccagccgttcggcggctttctgaatgttttccacatcattgtagagataataaacctgtcctccgcgcaaaatttcacgcaggatcgcctcccggaccaccatgctgtcatactcacggacaaaggttttaactgccagacgacgggcgggcggcgtggcgataatcgacaggtcacgcattccgctcattgccatattcagcgtacgtgggatcggcgttgcagtaagcgtcagaatatccacgttcgcgcgcatcgctttaatgcgctctttatgacgcaccccgaagcggtgttcttcatcgacaatcagcaggcctaaatctttaaacttgacgtcactttgcagcagtttgtgcgtaccgatcagaatatcgattttcccttccgccacttccgcaaggatttgcgtctgctctttggcgctgcggaaacgggagatcatttcgatacgtaccggccagttggcgaaacggtcgcggaagttgtcgtaatgctgctgcgcgagaagggtggtaggcaccagcaccgccacctgcttgtggttatctactgccaggaaagctgcgcgcatcgccacttctgttttaccaaagccaacatcgccgcacaccagacgatccattgccagcggctgacacatgtcgctaagtaccgcattaatggcctgcgcctgatccggcgtggtttcaaacgggaagctgtcgcagaacaactgatactgctcacgatcgtgtttaaacgcgaagccctctttggcggcgcgttgcgcgtagatatccagcaattccgccgccacatcacgcactttttccgccgctttctgccgcgcgcgtgaccacgcatcgccgccaagtttatgcagcggggcgttttcttccgcgccacctgcgtaacggctaatcagatgcagtgacgacaccggaacatacagtttggcgtcgttggcataggtgagcatcagatactcgccagtaatgccacccgcttccagcgtggtcattccggcataacgaccgacgccgtgctccagatggaccaccggctgaccaatatgcagttccgcaaggttacggatcagtgtatcggggttgatggtgcggcgagaatcctgacgacgacgggcaacgcgttcaccgagcagatcgctttcgcaaatcagcgccagattacgcaccgtatcgacaaaaccatgttcggcagcgccaatcatcagataacgcccacggtcgctggcttcatcaagacgcataatgcgttgcggagcaattttaattcgtgcgagcagttcacccagcgcttcacggcgaccttcactttctaccgagaacaccaccggaccgtcgaaagtctcgaggaacttacgcagcgcatccagcggcgctttttgttgtgcctgaacggccaggtctggcagtttctggaaacctaaattggcattcgcggcttttgtcggtaaatgttcagtttttagctgcacccggggccagtttttcagctctgagaagagctcgtccacccgcagccagagcgattgtggtggcaacagcgggcgcatcggatcgacgccgcgattctcaaaacgcgccagcgtgtcagcctggaaacgttcggcactggtttccagatcgccagtattcacgagcaaggtattggcagggaaataactgaacagcggcggcagtggttcgctgaagaacaatggctgccagtactcgatcccggcaggtaatgtgcctttactcacttgctggtaaatatgttctggatcgcgcttcacttcgaaggtatcgcgccactggctgcggaacagttcaattgccgctttatcggtcggaaattcgtgcgcgggcagcagattgatcgcttctacttcctccagcgtgcgctggctgtcgacgtcaaacacccgcaggctgtcgatttcatcatcaaagaaatcaagacgataaggcagctcactccccatcgggaagagatccagcaacgcgccgcgcgtggcgtattcgccgtgctccatcacctggtcaacatggcgataaccggcgctgtccagttgggttcgtaatgcatctcgtgacaggcgctgaccttttttcatcaccagcgcatgaccgtggagaaaactgtgtgggcaaacgcgctgcataagcgtattcaccggaacaatcagtacgccacgctgcatcgtcggtagctggtaaagggtggaaaggcgcgaggagataatgtcctgatgaggcgaaaaactgtcgtagggaagagtttcccagtccgccagattcatcaccatttgatcggtaaactggctgatttcatcatgcaaacgcagagcattttgcatatctggtgcaatgagtaccaccggaccggcgtgacgttcggcaatttccgctaccagcgttgcacaggctgcgccggttaactcgcccagcagacgctgctcacccgctttgacgggcagcgtataacgatattgttcaggcataacggttgtcagattctcgttaggatatgcctcaacatatgggggcatatctctgataagcaatgctgttcattatccgtaatcgacatggtttagcaaattgaatcgccccggctggggcgatggcttagcgggagtaactgacggcagcgggcagtgaaggcggggagaacaacagatcgctgaatgcacgctgtgaaagttttcttaccagcaagcccgcaacagtacagatgaacaaactgacaaagggataaaccagcaggagtgtcagttcgacttgcggcgaccagcgtgctgcgttcatttgcgcaagcagagttaagctgaatatttcaaccagaatgcgatgggtggtgtagatagcaatggtgttggagccaatcacattcagcaggctggtggagcgcataccgaatcgttgctcgtattgataaaacagcttcatgatcaccacaatcgataccagcgacaacagcagcgagatagtaaacaaccaggcaccgaccgccagaacggtaagcaaagaagccatcagcagatggcggcgcaacggcacctctttaacacaggtcattattgttgcgccaaaccatgcgccaaggctgtaataaggcaaattgcggatcacactgttcattccccaccacggcgtgggaacgaaattaaccgccacactcagcagtacaaacaaggcgaatagtggcagcgccagacggctaaaaattttacataccacgaaatagacaattaacgcatacagataccacaagctggtgctggcggtgatcatcccgtgcaggaactcaccggtggaatcggcataagcggcattggaggcattgcttaaatcgcgctcaggtgccagccactggttcagcgcacttaacgccagccactgcaccacgccccaaagcgccagcacccagaagatgttccagatccgtttatcgagacaatttccccacggtacgctgtcgatatagcggcgaatcaaatagccggatataaagaaaaaaaccggcatacgaaagggggcaaggtaaagattgaaatagatccagcatttgctcaggacttccgataacggatgctgaaaagtggtcagatgcggataaaaggtaatgaccgagtgataaatcaccaccagacaaatacataaccctttgatctggttaatccatagctctttttgtttcatcaggacaacacgctcttttttaatttacatgcggttgatcctgcgggttatgacccgaggtgtaatgggtatctgtctgtattggatgatttttcagattaagatcaggcggcaagattgatgataaaacatggcaatttagccgattgatttacgggggcttttcagattagccctgacgatcacttacagttcagacgtttacccatcttgctttcgcttatatactcgtgtctttgctacagcaaccagacggatttcatgtaccaacctgtcgctctatttattggcctgcgttacatgcgtgggcgtgcagcggatcgcttcggtcgtttcgtctcctggctttctaccatcggcattaccctcggggtgatggcgctggtcacagtattgtcagtgatgaacggctttgagcgcgagctgcaaaacaacatccttggcctgatgccacaggcaattctctcttctgagcatggctctcttaacccgcagcaactcccagaaacggcagtcaaactggacggcgttaatcgcgtcgcacctattactaccggtgatgtggtactgcaaagcgcgcgcagcgtggcggtcggggtgatgctcggtatcgacccggcgcaaaaagatccacttacaccgtatctggtcaatgtgaaacaaactgacctcgagccggggaaatataatgtcatcctcggcgaacaacttgcctcacagctaggcgttaatcgcggtgatcaaatccgcgtgatggtaccatctgccagccagttcacgccgatggggcgtattccaagccagcgcctgttcaatgtgattggcactttcgccgccaacagtgaagtcgatggctatgaaatgctggtgaatattgaggatgcctcgcgtctgatgcgttatccggcaggcaatattaccggctggcgtttgtggctggatgagccgctgaaagtcgactcattaagtcagcaaaaactgcctgaaggcagcaaatggcaggactggcgtgatcgtaaaggcgagttgttccaggccgtacgcatggaaaaaaatatgatgggtttactgctgagcctgattgtcgccgttgcggcgtttaacattattacctcactagggctgatggtaatggagaagcagggcgaagtagcgatcctgcaaacgcaaggcttaactccgcgacaaatcatgatggtctttatggtgcaaggggccagcgccgggattatcggtgcgatcctcggagcggcgcttggcgccctgcttgccagccagttaaataatctgatgccgataatcggcgtcctgcttgatggcgcggcgctgccggtggctatcgaacctttacaggtcattgttattgcgctggtggcgatggctatcgcgctgctgtctacgctttacccttcatggcgcgctgccgccactcaacccgctgaggctttacgttatgaataagatcctgttgcaatgcgacaacctgtgcaaacgctatcaggaaggcagtgtgcaaaccgatgtgctgcacaatgtcagtttcagcgtcggcgaaggtgaaatgatggcgatcgtcggtagctctggttccggtaaaagtaccttgctgcacctgctgggcgggctggatacgccaacctccggcgatgtgatttttaatggtcagccaatgagcaaactgtcgtcggcagcgaaagctgaactgcgcaaccagaagctgggctttatttatcagtttcaccacctgctgccggattttaccgccctggaaaacgtggctatgccgctgctgattggcaagaaaaagcccgctgaaatcaacagccgtgcacttgagatgttaaaagcggtggggctggatcatcgtgcgaatcaccgcccatctgaactttctggcggcgaacgccagcgtgtggcgattgcccgtgcgctggtgaataacccgcgcctggtactggcggatgaacctaccggtaacctcgatgcgcgtaacgccgacagcatcttccagttgcttggggaattgaatcgcttgcagggcaccgccttcctggtggttactcacgacctgcaactggcgaaacgtatgagccgccagttagaaatgcgtgatggtcgtctgacggcggaactgagcctgatgggggcggagtaatggcgatgcctttatcgttattaattggcctgcgttttagtcgcggacggcggcgcggcggcatggtgtcgctgatctccgttatttctaccattggcattgccctcggcgtggcggtattgatcgtcggcttaagcgcgatgaacggctttgaacgcgaactgaacaaccgtattctggcggtggtgccgcatggtgaaatcgaggcggtggatcagccgtggactaactggcaggaagcactggatcacgtgcaaaaagtgccgggtattgccgctgccgcgccgtatatcaatttcaccgggctggtggaaagtggcgcgaatcttcgcgcaatccaggtgaagggcgttaacccgcaacaggaacagcgtctgagcgcattaccctcgtttgtccagggcgatgcgtggcgcaattttaaagcgggcgaacagcaaattatcatcggcaaaggcgtggcggatgcgctgaaagtgaagcagggggattgggtgtcgattatgatccccaactcgaatcccgagcataaactgatgcagccaaaacgtgtgcgtttgcacgttgccggtattttgcagttgagtggtcaactcgatcacagttttgccatgatcccgctggcggatgcccaacaatatcttgatatgggttccagcgtgtcaggtattgcccttaaaatgacggatgttttcaacgccaataagctggtacgcgatgcgggtgaagtgaccaacagctatgtttatattaaaagctggattggtacttacggctatatgtatcgcgatatccaaatgatccgcgccattatgtatctggcgatggtactggtgattggcgtggcctgtttcaacatcgtctccaccttagtgatggcggtgaaagacaagagtggcgatatcgcagtattaagaacgctgggggcgaaagatggtttaattcgcgccatctttgtctggtatggattgctggcagggctgttcggcagcctgtgtggtgtgattatcggcgtagtggtttcactgcaacttaccccgattattgagtggattgaaaagttgatcggtcatcagttcctctccagcgatatctattttattgatttcctgccatcggaattgcactggctggacgtcttctacgtactggtcacagcattgttgctgagtcttttggcaagttggtatccggcgcggcgcgccagtaatattgaccctgcgcgagtccttagcggccagtaaaggcagtacattaaaacaaggagcggcaatgtattacgggtttgatattggtggaacaaaaattgcgcttggcgtgtttgatagcggtcggcagttgcagtgggaaaagcgggtgccgacaccgcgtgacagctatgacgcatttttagatgcagtgtgtgagctggtagctgaagctgaccaacgttttggctgtaaaggttctgtcggcatcggtattccgggaatgccggaaacagaagatggtacgctgtatgccgccaatgtccccgctgccagcggtaaaccgctgcgtgccgacctgagcgcacgtcttgatcgcgatgtacgccttgataacgatgccaactgttttgccctttcagaagcctgggatgatgaatttactcaatatccactggtgatggggttgattctcggcaccggtgttggcggcgggctgattttcaacggcaaaccgattaccggtaaaagctacattaccggcgagtttggccatatgcgtctgccggttgatgcgttaaccatgatggggttggatttcccgttacgccgctgcggctgtggtcagcatggctgcattgaaaattatctgtctggtcgcggttttgcgtggctgtatcaacactattatcatcaaccgttgcaggctcccgaaattattgcgctttatgatcaaggcgatgagcaggcaagggcgcacgttgagcgttatctggatttattagcggtttgtctgggaaatatcctgaccatcgttgaccctgacctggtcgtcattggtggtggcttatcgaatttcccggcaatcacaacgcaactggcggacaggctgcctcgtcatctcttacctgtagctcgtgttccgcgcattgaacgcgcgcgccacggtgatgcgggaggaatgcgtggtgcggccttcctacatctaaccgattaaacaacagaggttgctatgctgtcgcgtcggggtcatcggttaagtcgttttcgtaaaaataaacgccgcctgcgcgagcgtttgcgtcagcgtatttttttcagagataaagtggtgccggaagcaatggaaaaaccaagagtactcgtactgacaggggcaggaatttctgcggaatcaggtattcgtacctttcgcgccgcagatggcctgtgggaagaacatcgggttgaagatgtggcaacgccggaaggtttcgatcgcgatcctgaactggtgcaagcgttttataacgcccgtcgtcgacagctgcagcagccagaaattcagcctaacgccgcgcatcttgcgctggctaaactgcaagacgccctcggcgatcgctttttgctggtgacgcagaatatcgacaacctgcatgaacgcgcaggtaataccaatgtgattcatatgcatggggaactgctgaaagtgcgttgttcacaaagtggtcaggttctcgactggacaggagacgttaccccagaagataaatgccattgttgccagtttccggcacccttgcgcccgcacgtagtgtggtttggcgaaatgccactcggcatggatgaaatttatatggcgttgtcgatggccgatattttcattgccattggcacatccgggcatgtttatccggcggctgggtttgttcacgaagcgaaactgcatggcgcgcacaccgtggaactgaatcttgaaccgagtcaggttggtaatgaatttgccgagaaatattacggcccggcaagccaggtggtgcctgagtttgttgaaaagttgctgaagggattaaaagcgggaagcattgcctgatgcactacgcttatcaggcctgcaaggggacgcaattaattgaatttgcgggttttgtgggccggataaggcgttcgcgccccatccggaataatacacgcgcacttttccggcctcttttatcgtttactcgtcaataacaatgcggcaataaacgtacagacaccaattagccctgcccagagtggcgatattctggtaatcgcaaagctattatcgatatacaaacataaagcctgataacccatattggcaatagtcatcgccactgcaaattttaacgcataaataaaacgagtcgtgtagtaaaagatcctggaaaataagataaacgtcgcagcccaggcgataaaacctaatgtgttggtgctgccggggggagcattttcatgctgttgtcctggatgcggataatacgttagtggcggcgtcgattgttttaatatctgtgcttgtagaacagccaatgcattattgattccctgataccagagatctgcatttaaataagccagcgtgtgattttctatcagaaggccgagatgtttatcgtccagaccactttcaacctggccgttggtgatcataattaaccgtggttcgcgggtagtaaatagtaacagaacacttccttttacatcactcaatgaagatgacgcatgcgccagcatcgctttaccattttgtctgagactggcttcattattaatgtcgggtaaaaccacaataaacggtgcaattcccgtttgttggcgaaaaagctcggctttatgcgcgatctcttcagcatctggtacagtaccggtaacgtccgtaaaaagtgtcttcattattggaattaatggcttgctggctgctgtcagaggcaggagtatcagtaaactgagcagtataatgaattttttcatgggcgggacttccgtttcctgcgtgattttttagaggagggcatacttattaataaaccgacggcgataaaaataacgcccataatgccgataaacccccatttaaaaaaattaacccacgggttatttatctcagccttttcaggatgcccgggagaataataaacattaactttatcgccttcgctgtcttcataaaaatcgctgccgatactcgaattgaaaattagcgtgtaatctggcgtcggtcgaaaggcaacgacgggataccacgaaccatctttacccgtgcgatgagaatgactggagtgccagacggtatcaacaatgacgccttcggtatgaatcgcgtctttgctataggtgaactggttataaaagacaacaacagaaatgaggatcagtaccagaccgataccgaggaatatacgaaagaaaactttactgtcctgactcattagccacatccttgctaactaaaaaacgggcggtaataccaccgcccgcttgctgaattaacgtcctgctttcagcttctgataatactcttcataaatgctgctggctgcgccaacgtcattctgccattcgccatttttaatggtttcagcatccgggtagagtgttttatcgttcgccacttctggacttaacagcttacgcgccgcaaggtttggcgttggataaccgatagtttcagcaacctgttttgccacatccgggcgcagcaggaagttgatcaatttcagcgcgccttctttgtttttggcatttgccgggatcgccaggctgtccatccagaaaatgccgccttctttcggccacaccacgtcaattggcgtacccgcctggcgtgcaacgaaagcagaaccgttccagatcatgccgaggttaacttcgccttccatgtacgggttcgccgggttatcggagttaaaggctgccacgtttggcatcagttttttcagctcgttatatgcagcttcaatctctttcggatcggtggtgttaccggagtagcccagcttacgcagcgccatctggaacacttcacgggcatcgtcggtcaacagcaggctgcctttgtactctggcttccacagatcggcccagctggtgacagatttcggatccaccgcatcaccgttaacaccaatcgccgtcgcaccccagatatacggaatggagtagtcgttattcgggtcaaaaggcttgttgagcatgtctggatcgagattgctgaagtttgttaacttcgacttgtcgatcttctggatcatcccttctttacgcattttatcaacgtaataggttgaaggaaccaccagatcataggcaccgtctttgtatgttttcagcttggcgtacatggtttcgttcgactcgtaagtcgaatagataaccttaataccggtttctttggtgaactgttcaagcagtcctggcggcacgtactcggtccagttgtagaaatacagcgtgttgttgtcatcggcgtgagcggcgctcatgcccagtgccagagcacccgccgcgagcaggtggcgtgaccattttttcatttaacgtcccctgtgttacctttcgttttatcacgagcaataagctggctggcaataaccatcaccagcgacagcaccagtaatatggttgccagcgcgttaacttccggcgatacgccgactttgaccatcgaataaatttttaacggcagaatttcataacttggtccggtgacgaacgaagaaactaccacatcgtccatcgacagggtaaagcttaacacccagcccgccgccaccgctggcattgccagtggcagaatgatttttcgcagaatggtaaattcgctggcaccgagatctttcgccgcttccagcattcgcacgtcaaaacctttcaggcgcgaatacaccgtcaccaccacaaatggcaggcagaaggtgatatgcgagaacagcagcgaccagaagccaagctgaatacccagcagcataaacagcaccagcagcgaaatcgccatcacgatatctggtgacatcatcaccacaaacagcattccgctaacgaacggcttaccacgaaagcgataacggtacagcgcaactgccgtcagtgaaccgataagcgtagcaaacgtcgccgaaaacaccgccattgttagtgaatgctgcgctgcctgtaacaggctgtcgttgttcatcagcaggctataccatttggtggtaaagccctgccagttgatgccaaagcgcgagctgttaaaggagttcacaatcaaaataatgattgggatatacaggtacgcgtagatagcggtcataaaaccgccgcgaagcagtcgaccgatcattcgagttccaccttcttattcagcaaacgagaagcgcgccagtaaaccagcaacatcaggcccattacgatagtcagcgtaatgctggtagctgcaccaaacggccagtcacgaatattaaggaactggaccttgatgacgttaccgatcagcaggtttttcgcaccgcccatcaggtcggatacatagaacaggcccatcgctggcagcatcaccagcagacatccggcaataattcccggcatcgtcagtggaataatgatacggataaaagtctgtaacttgctggcaccgagatcgcgcgccgcctcaagcaacggcttatccagtttttcgatactggagtacagcggcatcaccataaacggcagcagaatgtaaaccagaccgataatcaccgcactgggcgtgaacatgatacggattggtgtgtcgataacgcccagccagagcaaaaactcgttgagatagcctttggtgctgaggaaaattttcagcccgtagatacgaattaatgagttggtccagaacggaacaatcagcagaaacagcagcagcggacgcaccttgtgtggcaacttcgccagaaaccaggcaaacgggtagcccagcaccaggcaggcgagggtggcgatcagcgccatattcagcgagtgcaatagcacttcaaaatagagcggatcgagcagacgcgtgtagttatccagcgtaaagaccattttgacaaaactggcgtcgtcgcgggtcaaaaagctggtgccaatgatcatcaggttgggcagaaagacaaacaacacaagccaaccgacaatagtgacaatcactacattctggaacttacttgtgttcttcatcagccagtacgacctcccagctttctacccaattaatggccattttttggtcgagagagtggtcaaagtcaggatcgtcttcattgaagaattcgctgaccatcaccatcttgccattttccagttcaacaaccgactccagcgtcatgcctttgtagttacgctcgcgaacgtaaccaatcagcccttcagcgtggttgtcgtcgttaatctcttcaacacgtaagtcttccgggcgcagcagaacatgcagtttttgccccggttcaacggcgaagttaacgtagatattacattcgcggccttcaacgttggcgcgtacgcgctgctcgtctagacgttcgatgacagtggcgttaaacatattgatttcgccaatgaagccggcaacaaacaggtttttcggctcttcgtagatttcacgcggcgtgccgtcttgctcaatgcgaccatcgcgcatcaccacaatcctgtctgacatggtgagtgcttcttcctggtcgtgagtcacaaagacgaatgtaatgccaagcttacgctgtaacgctttcagctcgttctgcatttgcttacgcagtttgtaatccagcgctgagagcgactcatccagcaacaacagacgaggcttgttaaccaccgcgcgagcaatggcgacgcgttgctgttgaccaccagagagctgatgcggtttgcgttgagcgaaggtttccaactgcaccatccgcagggcttccatcacgcggggcgtaatttcagcagcgggggttttttgcatgcgcaacccaaaggccacattttcgaacacggtcatgtgggggaaaagtgcgtagctttggaaaacagtgttcacatagcggttttccgccggaacgtgggtgatgtcctcgttatccagcatgatgcgtccggaatcaacagtttccagacctgcaatcaggcgaagaacggttgttttaccgcagccagaagggccaagcagcgtgaggaactcgccattgttgatagtcagatccagctggggaatgacctctttaccatcaaagcatttgcgaattcccgccaattgcaccagcggtgaaagcgaactcggttgtttattcaattttttactctgtcccatgtaaacgcaacggatggcttaccgatgcggggtttgtggttaaccaccttggtgactcttaatgagggcggtaattctacggcaaaccgcttgaatcgccaatctttgttgtgaattactggcttagctttatattcattaaggtaatgctgataaatattcccgcttgcaggggtaaaagtgacctgacgcaatatttgtcttttcttgcttcttaataatgttgtcacaaaaagtgagggtgactacatggataaactacttgagcgatttttgaactacgtgtctctggatacccaatcaaaagcaggggtgagacaggttcccagcacggaaggccaatggaagttattgcatctgctgaaagagcagctcgaagagatggggcttatcaatgtgaccttaagtgagaagggcactttgatggcgacgttaccggctaacgtccctggcgatatcccggcgattggctttatttctcatgtggatacctcaccggattgcagcggcaaaaatgtgaatccgcaaattgttgaaaactatcgcggtggcgatattgcgctgggtatcggcgatgaagttttatcaccggttatgttcccggtgctgcatcagctactgggtcagacgctgattaccaccgatggtaaaaccttgttaggtgccgatgacaaagcaggtattgcagaaatcatgaccgcgctggcggtattgcaacagaaaaaaattccgcatggtgatattcgcgtcgcctttaccccggatgaagaagtgggcaaaggggcgaaacattttgatgttgacgccttcgatgcccgctgggcttacactgttgatggtggtggcgtaggcgaactggagtttgaaaacttcaacgccgcgtcggtcaatatcaaaattgtcggtaacaatgttcatccgggcacggcgaaaggagtgatggtaaatgcgctgtcgctggcggcacgtattcatgcggaagttccggcggatgaaagcccggaaatgacagaaggctatgaaggtttctatcatctggcgagcatgaaaggcaccgttgaacgggccgatatgcactacatcatccgtgatttcgaccgtaaacagtttgaagcgcgtaaacgtaaaatgatggagatcgccaaaaaagtgggcaaagggttacatcctgattgctacattgaactggtgattgaagacagttactacaatatgcgcgagaaagtggttgagcatccgcatattctcgatatcgcccagcaggcgatgcgcgattgcgatattgaaccggaactgaaaccgatccgcggtggtaccgacggcgcgcagttgtcgtttatgggattaccgtgcccgaacctgttcactggcggttacaactatcatggtaagcatgagtttgtgactctggaaggtatggaaaaagcggtgcaggtgatcgtccgtattgccgagttaacggcgcaacggaagtaagcgaaaagggatgcggcatgtgatgccgcatccggcttaaatccaaacttacccttcgaagaaccaatacccgctattgaccagcgccgcgagcatcgcgaggaatgacggatcttccagcgcatcgccaaaattctccgcagtcagcgcaatgttgctggcgagtgcatccagtgccggacggtgcggggaatcgatcttctcaccattggcatacacgtcgtcgccaatgcgcaatacgcgcagaccacccaggcgcaccagcacttcaccttgtttcagcgcatcgtagatttcatccggctgataaggcggctctggcggcgcgatatccagttcatgacgtgactgggatataaactcgccaaaccattgcttaaagtgttccggctggttgatcaattcgagcatcatctcacgcagtttatccatctcttgcggcagaacatccgcaggatgagcgcgaggtggaacatccggatcgctgtagtagttgccgcccagttcacgttgcagcacataatcggcaaatccactaatcagttcccgcgtatttggcgcgcgaaagcccacggaatagttcatcgcattttccagcgcgtagccttcatgcgggaatcctggcggaatataaagaatatcaccaggctccagctcttcatcgatgatggcttcgaacggatcgacctgtaacagatccggatgtgggcagtgctgtttcatttgcagcttttcgcccactcgccagcgacgacgtccggtaccctgaatgataaacacgtcgtactgatcgagatgcgggccgacgccgccgccgggtacagaaaaagaaatcatcagatcatcaatacgccagtccggtagttcacggaacggtcgcatcagcgcggcggtcggctcatgccagtggttcactgcctgtaccagtaatgaccagttggtttcaccgagatgatcgtagctttcgaacgggccgtggctgacctgccatttgccatcctggtgactgaccagtcgactgtcaacttcgctttccatcgccagacccgccaactcgtctggagagatcgggtcaataaaattattaaagccgcgttttaacaccaccgggcgtttctgccagtgacgttcaagaaaatcgggccagttaagagtgagttggtattccatgttaagcatccacaggctggtatctgcaaccgattataacggatgcttaacgtaatgcgtgaagtatgggcatatttattcatctttcggcgcagaatgctggcgaccaaaaatcacctccatccgcgcaccgcccagcatgctctctccggcgacgattttaccctcatattgctcggtgatttcgcgggctaccgccagccctacaccttgcccagggcgtaaagtatcaacccgttgaccacggtcgaaaatgacctctcgcttgcttaatggaataccggggccatcatcctcgaccacaatatagagatgctcgtcggtttgccttgcagaaatttcgacaaactcgaggcaatatttacaggcattatccagcacgttgcccatcacctcgacaaaatcgttctgctcaccgacaaagctgatctctggcgaaatatcgagagagatattgacccctttgcgttgatacactttgttcagcgctgaggtgagattgtccagcagtggggcgaccggatgcagctcgcggctgagcaatgtcccgccgcgcatactggcacgatgcaggtagtagccaatttgctgtgaaatgcggctgatttgctccagcattaccggctcagcatcactgacgctcatcttttcactacgcagagaacgcagcgtactttgcagcaccgccagtggcgttttcagactatgggtcaggtcggtgagcgtcgtacggtatttgtcgtaacgttcgcgttcactttttaacaatcggttcaggtttcgtaccagactggtcagttctcgcgttgtggctggattgagcaattcgcggttatgttcttccagttcgcggacttcttttgccagggcttcgatggggcgtaaactccaccaggcggcgacccacagcagcgggatcactaacagcagattggctgagagcacatagataaaccagctccagaccatataggaactttttagctccaccggaatggtatccaccaccacaatggttaattttggcatccgcgatgttgccgggtagacgtttactgccaccgagtgggtcatctccgcgtcgtcatcatcttcccgcacttcctgcaactgttgctgtatcgaatgatctccactcagcaagaggctggtatcgttaacatccgcttcaatttcatgaaaaccattcgatttcagccagtcaggctggatcatcttcatcagccagggcacgtcacgttgcgcccataaaagctgcccgttctcatcataaattagcgtcatggtggggctttgcttgtcgatattttcgggtaactcgacatgcaacttattgttttcccacttcgcaagggtatagaacagattgctctcgccacgtaacagccgaaacgtagttttatcgaaactgacgctataaccgatcagcgcgaccattccgtaggcaagcgaaagcaccagtactaccgctgccgttgccaacagaaaacgtacccgcagcgagagcgggaaaaaaagacgcagtaattttttcatcagcgcaattcgaacagatagccctggccgcgaacggtggtaatcacttcttggggatattgtgcctgaatttttttgcgcagacgtcccatcagtacatcaatggtatggctttcccgcagctccgcatccggatagagttggagcattaacgaatctttgctgaccactttgccattattgcgtatcaacgtttccataatagtgtattcgaacgcggtcagtttgatcacttcgtcattaatagataattcacggcgagagagatcaacctgaaacggggggagcgaaatgacctgtgaagccagaccgctattacgccgcattaatgcctgcattcgcgccatcacctcttcaatatgaaacggtttagtcacataatcatcagcaccggcacttaatacttcgactttgtcctgccagctttcacgggcggttaataccagaatcggcagtgaaacatcgttgctacgccagcggcgaatcagtgacagaccgtcctcgtctggcaatccgagatcgacaatcgcaatatccggtatatgttcattgagataataatcggcttctttggcatcttctgcgtcatcgacctgatgaccagcatcctgaatctgaactttaaggtggtgacgtaacaacgcattgtcttcaacaaccagtacgcgcatttttatttctccctgtcttaattattaaaatagtgtaacgcgattatgtggttatgggggtaaacattaaataaaccagcggggaggggaggtaaagtgaaaaaataaaaagcggataatcttaataagcaggccggacagcatcgccatccggcactgatacgaggtttatttcagctcatcaaccatcgtgatagctcgaccaatatagttagccggcgtcatcgctttcaggcgggctttctcttcttctggcaacgccagaccatcgataaactgcttcatgccttcggcgtcaacgcgcttaccgcgagtcagctctttcagcttctcgtacggtttttcgatgccatagcgacgcataactgtctggattggttcagccagcacttcccagttgtgatccagttcatccagcagatggtcacggttcacttccagtttgctcacgcctttcagggtggattgatatgcaatcaaggcataaccgatacccacgccgaggttacgcagcacggtagagtcggtcaggtcacgctgccagcgggaaaccggcagtttgcttgccagatgctgcaataccgcgttggaaaggcccagattcccttcggagttttcgaagtcgatcgggttaactttatgcggcatggtggaagaaccaatctcaccagcaatggttttctgtttgaagtggttaagggcgatataaccccagacgtcacggtcaaagtcgatcagaatagtgttgaagcgcgcaacgcaatcaaacagttcggcaatgtagtcgtgcggttcgatctgggtggtgtacgggttccactgaatacccagcgaggtgacgaactcttcgctgaactgatgccagtcaacttccgggtaagcggcgatgtgggcgttatagttaccgaccgcgccgttgattttgccgaggatctccacctggttaagctggcggtactggcgctccatacggtaggcgacgtttgccatctctttaccgatggttgacggcgtggctggctgaccgtgggtacgagacagcagcgggatatcgcgatactgaacggcgagatctttaatgccatcaatcagttgacgccagtatggcaggatcacttcatcacgcgcggttttcagcattaatgcgtgggagaggttattgatatcttccgaagtacaggcaaagtggatgaattcagaaaccgcgtgcagttccgggatctccgccactttttctttcaggaaatactcaaccgctttaacgtcgtggttagtggtacgctcgatagttttgatgcgcgccgcatcttcttcgctgaaactggcgacgattgcatcaaggtaaccgattgcgtcggcagcaaaagcaggaacttccttgatcgctgcgtgcgcggccagtttttgcagccaacgtacttcaacttgtacacggaatttcagcaaaccatattcgctgaaaatcccgcgcagcgcgctgactttatcgccgtagcgtccatcgacaggggaaacggcggtcagtgaggataattccatagatcacaactccggggttaaatgagcaagaatttgttttgcctgagtggtcaggcgattacgagaaaacatcagttgcagacgtccgccgccgacctggtgccagagcacggcggcgcgaatgcctgccagcagggttgcgcgaactttcgcctgcacttgtgggctttgcagtacagcaggggaaccggtgacctgaatgcgcgggccaagcgggctaatcacatcaacatagatagcagccatcgcgctcatcagcgtttcggactgtaaatcgaagtgttcgagctggcgttgcaggccgttgatccggttgcccagagtgtcgagcgcgcctttcgctgaggagagtttgcgctcaagcaccatcaagctgagtgtgtagcgggttaattcggcgtttaagccctggcgactgctggcattgagcacgccgagcagggtttccagcccgacgcgcaggttggcttcgctaccgccaaaaaccgccagcgtcgagctggggttcatatcaataatactgttgagtgagacgtgtagcgcatcggcatcacaatgcccctggtgagcgagttgttgcaccaggcgtgccgactgacaaataccggccagggcgagggtgatgtcatagtaattctttgccacgttcactgcttccttgttttaagtaaagataataatcagaccggcagcggcagacgctgctcaataataccgccaccgaggcacacttcaccgttatagaagacggcagactggcccggcgtcacggcggcaaccggttcatcgaaaatcacttcaatgcgatcatcgtccagcgccttgacggtgcaagggatatcggtctggcgatagcgggtttttaccgtgcaacgcatagtgccggtgaatggttcgcgatcgacccagtgcaactgctgggcaatcaacccgacagacatcagccgcgggtgttcatggccctgagcgacaaccagaatgttgttttcgacgtctttgtccaccacataccacggttcttcggtaccttctttggtgccaccgatacccagacctttacgctgaccgagagtgtgatacatcagcccctggtgctcaccaatttcatcgccatcgacggtaatgattttgcccggttgcgccgggagataacggcccaggaactcgcggaatttacgttcgccaatgaagcaaatgccggtagagtcttttttcttcgcggtgaccagaccaagatcttcagcaatcttacgcacctgcggtttttccagttcgccgaccgggaacaggctttgcgcaatctgctcatggctgagcgtataaaggaagtagctctggtctttattgctgtccagaccacgcagcaggcggctcttgccatcgacatcggcccgacgtacgtaatgaccggtagcgatataatcggcacctaaatcttcggcggcaaattcgaggaaggctttaaatttgatctctttgttgcacagaatatccggattcggcgtgcgaccggctttatattcggcaaggaacagttcgaagacgttgtcccagtactcggcagcaaagttaacggtgtgcagttcaatgccgagcttgtcgcagacagcctgggcatcagccagatccgctgccgctgtgcaatattcctcaccgtcgtcttcttcccagttcttcataaacaggccttcgacctgatatccctgttgttgcaacagccaggcagaaacggaggaatcgacaccgccggacatgccgacgattactttttttgcggtttcagacattggatcactcacgacattgaacttcaaggcggcgtattctatcacgcagccttttagatgacaccctttgtaaaaggccagttaaaatcgccaatcatctccagcggataacgttgcccgctttgataacaacgaatactttccgccaccagcggcgaacgaagatttgacgcctgtaaaatttcttcggcgctgacccaacggcagcagtcgatatcgctgtcatgaggctgggtcgggcatatttgctcaagctcaatggcaaagaggaaacgcaaaaacggcgttttatctggcgcaatccactgatgcatacgaataaagtgttgcggctgcgcgctgatgccggtttcttcccacagttcacgggcggcggcttccactaaggtttcatcggcttccagatgcccggcaggttggttccataacgctttaccattaatcgtctcttcaacgactaaaaatttgccttctgcgtgcaccacgcaagcaacggtaacgtgcggtttaaacattttgcatccttaatctgtcacttctcgccattcaccattggcaagattatccaaagagtaatcacccatcgcatagcgaatcagtcgcagcgtggggaagccaacatgggcggtcatgcggcgcacctggcgattacgtccttcatataaggtgatcttcagccagctggtgggaatacttttgcgttcacgaattggtggattccgcggccataaccacgcgggttcgtcaaccagctccgcgccggcgggcagggtagggccatcatttaaggttacgccattgcgcaaggcttcaagtgcgtcttgtgtgggaataccttccacctgcacataatagatttttccggtgcgtttacccggctgggttaaacgcgcctgcaacgcgccgttattggtcagcaccagcaacccttcgctatcgcggtcaaggcgacctgctgcataaacaccctgaaccgggatgaattcttttaatgttttgcgtccggcttcatcggtgaactgcggaagaacatcgtagggtttattgaacaggatcacacgcgtgggctggttttcaggtttacgcctggtagaacgttgcgagctgaatcgcttaacctggtgatttctaaaagaagttttttgcatggtattttcagagattatgaattgccgcattatagcctaataacgcgcatctttcatgacggcaaacaatagggtagtattgacaagccaattacaaatcattaacaaaaaattgctctaaagcatccgtatcgcaggacgcaaacgcatatgcaacgtggtggcagacgagcaaaccagtagcgctcgaaggagaggtgaatggaaagtaaagtagttgttccggcacaaggcaagaagatcaccctgcaaaacggcaaactcaacgttcctgaaaatccgattatcccttacattgaaggtgatggaatcggtgtagatgtaaccccagccatgctgaaagtggtcgacgctgcagtcgagaaagcctataaaggcgagcgtaaaatctcctggatggaaatttacaccggtgaaaaatccacacaggtttatggtcaggacgtctggctgcctgctgaaactcttgatctgattcgtgaatatcgcgttgccattaaaggtccgctgaccactccggttggtggcggtattcgctctctgaacgttgccctgcgccaggaactggatctctacatctgcctgcgtccggtacgttactatcagggcactccaagcccggttaaacaccctgaactgaccgatatggttatcttccgtgaaaactcggaagacatttatgcgggtatcgaatggaaagcagactctgccgacgccgagaaagtgattaaattcctgcgtgaagagatgggggtgaagaaaattcgcttcccggaacattgtggtatcggtattaagccgtgttcggaagaaggcaccaaacgtctggttcgtgcagcgatcgaatacgcaattgctaacgatcgtgactctgtgactctggtgcacaaaggcaacatcatgaagttcaccgaaggagcgtttaaagactggggctaccagctggcgcgtgaagagtttggcggtgaactgatcgacggtggcccgtggctgaaagttaaaaacccgaacactggcaaagagatcgtcattaaagacgtgattgctgatgcattcctgcaacagatcctgctgcgtccggctgaatatgatgttatcgcctgtatgaacctgaacggtgactacatttctgacgccctggcagcgcaggttggcggtatcggtatcgcccctggtgcaaacatcggtgacgaatgcgccctgtttgaagccacccacggtactgcgccgaaatatgccggtcaggacaaagtaaatcctggctctattattctctccgctgagatgatgctgcgccacatgggttggaccgaagcggctgacttaattgttaaaggtatggaaggcgcaatcaacgcgaaaaccgtaacctatgacttcgagcgtctgatggatggcgctaaactgctgaaatgttcagagtttggtgacgcgatcatcgaaaacatgtaatgccgtagtttgttaaatttattaacgggagcgtaacgctcccgttgttttttgttaggctgctaacggttatcaaaattttatcaaaaaaagttatcaaaacccctcggtagttttggggtaggctggccggtcaggtggtagttctactactagtctcccacatagatattccttagctttttattattgctggcggacgctcgttaatatttaaggtcttcattgattaagacatccccaaagttagttatgtattcactgttattaggacaattatgaattaccactccttacacccgctcaaatattgttaaattgccggttttgtatcaactactcacccgggactcgccaggggacagccaacaggcattgggtgcaatcaccttagcgttcaggtacatgcggaatgtaaaaaaggccgcgagcgcggccccttcacatacatctttagtactgagactgtttaacctagggaattattatcgtattatattgcattacaactcccaacagtgacatatgaacttcctgctttactccacgactttaatatttcaaggccatgtgaagaacatatttcttgcactgcgagttcatcgagtaatccatagtaagaaacactttttgaatttttgtaaatgtatccgtaaagatgttttcttcctgtttcgtattttttgaagtatgagcttttatattgatttacaataagagtctcacctcctgattttagtaatctcttgatgctaagaactattttgtcgattgtatcccgacaaggaacggcagagagaacattagagcaaaggatgaaatcgtaacccccaattattttgtcgacatcctcgaaagcaactgtatttgcatttttataatatcgtgggacatagtcaataattttagttttaattcctctaataatttgctctctttcaagttgccttttcgagtctagaaaagtaacttcatcaaatttactgattaattcatcagaatatctaagttttccgcagccaaaatcaagggcgtggccatttttctcaatgcttctaatatactcgcaaagatatctagagggcatcgtatgaggttttgctgcattctctgagcgaatattaactccgtgcatattatagttcaaagcaagtaccattcaattaatgttatttttagtgaaaaattcttttattttatcgtccgggatttttccgacttgactttcagttctgggcttaactgtcaaagcaaagataataccactcactgagaatgataaaattacaaaaaagaataaagacagcaaagaaccttcaacatgaaaaatatccatttgtttgcaaaaaaagattattaggaaggaaattaatgcaattatcgaaaattcaaaaaatatccaaaaatagtatactttattccagaagagttcaatataatgtttgtcttcaatttttcttacttcagggtaatatagattgctcattacattgtgagcttcatctttatttaattttctgttgactccagctctccgtgataacggttttataattagatgcttatcccaaagatatcgcacccgaagtagtttggctgcattgttatgtaggtctaacgcaccgctaattaaatatgcaaaaatcgcaaaagcacaaggtaatataccaaaagatagtgcccaattaataaagctctcatgatctttaataggtgggacatacttggttggtaatgttattaaagggatgtattcgtaaataactagaagtatgcaatatattagcgtatttaagaaagttgctttatgaagtttaggcaacatttcattataatttttggggggttcgaacatattattcacctgagtcacgctttaggatagtgtaatggtaatatttaattaagtgtcattatatacttttcagtaggttagttacaattttttgtatctgttcaggctgacctagcttcgctgacagacaatattgtgatcagtagcacgtatcgaggaggagtagcgctacaaatttgacgctgggtgagaatctgaaattgatagaaatgaaataatgaaataatgaaatgatgaaatgatgaaatgatgaaatgatgaaatgatgaaatgatgacagagtgtccagtgggcacggatggtgtcttacgacatgcttaccttaatcgttcccagtgtgcctatagcagatattctaaacatgtcgataattcattacgcatatagtatcgaacatagaaaaaactgaagattcatcttattttgtatatactacctagcccaacaatgtagaggttaacgaaaaatgcgctcaccaatttgtcatcttttctcagcaattaattcatcaccatttaagattgcaccagagaaggagcaagatcttaaaacgatagttgacgacaaaaaaattataatttcagttgtgagtgaacctggttttaatatccgagtcaggaagaatgagagtaataattcacatgaaatagttctaacagtagcttcacttgaatatatttgggcattttccaatttcttttgggtttttacgcaagagtactccaaatctcagaaaaataatgatgagcactttgatttaacaggaaaaaataggcttaaaaagtctgatgaacttcttaaatgggcaaggaaaaacttgcaaacaacaggttgcgaatcatggcctaaaaaatgtcccaagccagaagcatatttacaaggaagcgaagactcacaagttgctagcgagatatttctttgtgctattgcttggattcttcatcatgaaataagtcatgttgttttacagcatccattggtcactacagcattctccactcaagaggagcgtgaagcagattcacatgctacaaaatggatattaggcaacctgtatgaatccgctcctgaattaaagaaacgtgcacttggcattgctacggcagtgctttgtatacaaagcttagaagttgaaaattacttctgtttacaaaatacacacccagctgcatatgagcgtatatattcgaatatttcatgctaccctgtcggaaatgaagagttgattgaagctctatgtacagtgatgcttcaatatcttttccatggcaaaaatatcaatgtgaatctagatggggagtccttttcatcgattttaggtgatcttctctgtgatatttcacgtcttaccagtaactgatatggctgtccgccgctcgcttaaagtggactttttagtttttatcatgtgcggtgagaaattcaatgtggcgttgagatgcttaaaggttcacaacgctactttgctccatcctttacctcgatcatcatgataacgatcggtttgttgttgtgttttatgaccaagtagtttttgtgtgtctaacccctgttctttatacagacgttcagataaagacctttgctcatggaatgtcgcaggtgaaccctctccccagtcaattcttgctaaatctctcgctttactaaaattcatcgtcaatgtattggctttaacctgcgctccgcgctctgcttgtgaagttgaacgaaaaaaatgcactaagtatgcactgactgcatagtcacggcagcgggctactacatcgcgtaaactccagttaatcgcattgaggcgaagagaaagaggaattgcgattttgctcccggtcttttcctgaatgacatgaagatgatcatcccaaatatcgctaaatttcatacgcgaaatatcacctaaccgctgaccagtaaccagcgctaacagcatggcatttcccatgtaacgatgagtagcgtctgcgatatcgaagatttttttccattcttcaaggctcagccgttgtcgggtaatttttcttcttggttgtttagtggctaatgctgggttatagccaggaggtacttctccgtagtgctgcgcctctttgaaaacatcaatcaggacggagcgaactacttgtgccattcttggccgcccagcggcgatatactcatcaagcaattgtgctatatctctgacatcaacggctgagatcaacttcattcctgctcgttctctgagcaaggatactggtttagctttttgtttataggtgttgagtcttatatcaccacttttaagcctgtcatcctggatcgcttgatagcgatctaaccaggttgacgttgtgatagcctttcctttgctggttgcgatcctgtcactgatagccagaatctgccgggttctttgttcagccaggcgagtgttggcctcagtggcaatagcgatagcttcagcttcgtttgttcccaaagcatggaattttcctgtcactggatgcttataccgccaatagactttatttaccttcctactataaagcggatataagttagggactgaaacattattcttacgcggtctggctgccattactcaaaatccgttgcaaaagtaatgagtcatttttcttgattacaggtgttaccaactccccaactaactcggcgtcctcacgcactcgccataaccggccttgtttcatggccggtggacaaaataaattctgcttagcataacgacgcaatgtggacacacttggaggattacttctgtatttttcagcagcccattcttcaagagttaacatttgaagcatatgcgatcaccttattactacactaactgcttagtctcagcatatcgaccctgcacggtcggttagtttctccacaaaacagagaagagcacctgtggccacagctatcaggatgggtcgggttattaacccgtcatccggggatactcttctctgttttgtaaaaagggcggtaccagaaaggactaaggaaaaaactggtaccgccaagactacacacagcataaagttgtggtgtcgggtgcccccggtgcctggcgaaggttgcacaccaggcgggtgggtatccacagaaggtcgattgtcagcctcaaccttaacccgcgtgcgctgagccgcattcaccacaacgctaaggattctctctggttgaaaatacttagctgttatgtgcctgtcttttcaccacttcaggctcggtggtatgctggagttctcacacagccagcaagcaaggaaacttaatgaaccagttttatgttcacgttcgtctatttgaagacacagccgaacagaccaaaaaatttgaagaattaatgcttaactttctgtaccagaaaacagttaaagagtctgacgatagctgctgcagactgattccagagggatatatcctcaaaagtacaatgaactgccaacaaatccttgatcaaacattttcaattgctaacagtgccggtgttgacgcaaatatatttgtctgtaaatttgaacaaagcgcatgcttacttccgtctgcttccttagttggtaacgatttcgttcattacgatcttacgcctaagcccatcaagctcgattcttaaagccttaaccattgtgtcgtgataaacacggctcaccttctctccattgcatggcagaggggtgagtgtgttagccatgaaattcatgaactcggttcgaccaggggcttgcgccccgcaagtctttaatgcctgttttgctaacaaaatgcgggcctcagtgcctgcatttggctctatctgctgcaaacgtttagcgtcttccagcaacaatgcgatcacatgcttcaaattctgctcattcatctattctctccactgaaatcatccgctaacgaatcatcccggtcttcgtacgtaccgggcgggctacttcgtgggcgtcctgcctgtttgttgtttctcttgggtacattatgtatctcaaaggtacattgtcaagtataaaaaaacctgccgaagcaggttcataaacattgattaggctttgattttgtatcttcttggttttcctgagaaaatcacagtaccaattatagagcaattaccgttgatcttaatgtaaggctcaggccagtttgggtttaacgctttgagataacgctgtgtcccatcttctatcaaccttttgaaggtggtttcacctgtatcgtgcatcaatgcaataacgtcgtcaccgtggcaggcaggtacttcaggatcgacaaaaatcatgtctcccgggcggtactcatcaatcattgaatcacctattacccgcaagatataagtcatttccccacagggtacagggcagggatacgtttctgctgtgctcaaatcaacctcagaatatccaacttctttccatgctccggcctgtacccatgatatgacagggactaatgtgatttgtttattagtgattgaaacatcaggtttttttgtgatgttcgttgtctggtgttcttgatcgagccatcctacaggcaggtcgaaacatttttcgatgtgtcgtgccatgctgtcaccgatatttttagtagcaccatctcccataaacctgctggtctgggttggctcgcgatcaatcatagtggcaaaggaagaattcccgccaacaccatctctcagttttctggcgttagaccgccggatgtcatggattgttttcataacgaaattaaaacccttgtaccgttaaggtacaagtatcttgaaggttcatttcaatcatgtaatatgtacaccggaggtacatattgtatgaaagcgtattgggactctttaaccaaagaacagcagggcgagttggccggaaaagttggctcaacacctggctacttacggctggttttcaatggctataaaaaagccagttttgtgctggctaaaaaacttgagcaatacacatcaggtgcaattacgaaatctgacttaagaccggatatctatccgaaagattagcagaacactttcaatttttaaccacagaacgatgaggctaatcgtgggtaagcatcactggaaaatagaaaaacagcctgagtggtacgtgaaagctgtcagaaaaactatcgcggcgttgccgagtggttacgctgaagcggctgactggctcgatgtaacagaaaacgctttattcaaccgccttcgtgcagatggcgatcagattttcccgctgggatgggcaatggttttacagcgtgctggtggcactcacttcattgctgatgctgtggcgcagtctgcaaatggcgtctttgtgtctcttcctgacgtcgaggatgtggacaacgccgatattaaccagcgtctgctggaagtcattgaacagatcggcagttattcaaaacagattcgttcagcaatcgaagacggtgtagtggaaccgcatgagaagacagcaattaacgacgagctgtatctctcaatttcgaagctgcaggagcatgcagcacttgtctacaaaattttttgcatttcagaaagtaatgacgcccgcgagtgtgcagctccgggcgtcgtggcgtcgattgcttctggttgtggagaaactaacgcatgaacagtttaacaacacactaccgtcgctcgcaactgattgcgcttcctgtaccgggtggaaaagcgaaggtggaatattgctatgcagtgaatgtaccaggtgacagggaaattgtaacccacagctttgcagagtgggctgtgggtgatttcaaccggcagaaggagacagtcctttgcgacaagttaaccgctggttcaaagatcactacggagtgcccgtcagagtcattcgttgggagccggaaacacaacgggttatctacctccgcgaaggttatgagcatgaatgcttcagcccgctcgaacagtttcgtcgtaaattcagggaaatagaggtcggtcatgagcactaaattaaccggctatgtatgggatggttgcgctgcatcaggcatgaagttatccagcgtggcaattatggcccgcctggctgatttcagtaatgacgaaggtgtgtgctggccatcaattgaaaccattgcccgtcagattggcgcggggatgagtaccgtcagaacggctatcgcacggctggaagcagaaggctggttaacgcgtaaggcgcgtcgccagggtgatggttcatcaccccactgtgccgtggtggatgaatatcacgagcacgccacagatgcgctttacaccacgatgcttaccgggatgggggcgcgacgccagccactgatgtgggccattaccaccgccgggtacaacattgaggggccgtgctacgacaaacggcgggaagtcatcgagatgctcaacggctcggtgccaaacgatgaactgttcgggatcatctataccgttgatgaaggtgacgactggaccgacccgcaggtgctggaaaaagccaatccaaatattggcgtgtcggtttatcgcgaatttttgttaagtcagcagcagcgtgcgaaaaataacgcccgtctggcaaacgtctttaaaacaaaacacctcaatatctgggcgtcggcgcgttcggcgtatttcaacctggtgagctggcagagctgcgaggataaatcactgacccttgagcagttcgaggggcagccgtgcattctggcctttgacctggcgcgtaagctggatatgaacagcatggcgcgactttatacccgcgagattgacggtaaaacgcattactacagtgtggccccgcgtttctgggtaccgtatgacacggtgtacagcgtcgagaaaaatgaagatcgccggacagccgaacgctttcagaaatgggtggaaatgggcgttctgaccgttaccgatggtgcggaggtggattatcgctacatcctcgaagaggccaaagcggcgaacaaaatcagcccggtcagtgagtcacccatcgaccccttcggggcgaccgggctgtcacatgaccttgctgatgaagacctgaaccccgtcaccatcattcagaactacaccaacatgtccgatccgatgaaagagctggaagcggcgattgaatcggggcgctttcatcatgacggcaatcccatcatgacctggtgtatcggcaacgtggtcggcaaaaccattccgggtaacgatgatgtggtgaagcccgtcaaggagcaggcggaaaacaaaatcgatggtgcagttgcgctgattatggcggttggcagagccatgctgtacgagaaagaagacacgctgtctgatcacattgagtcctacgggatccgctcgctttaactgaggtaattatgatcatgctgattctcgcgcctctggtgggcgtgctgggtgcgcttttgctggcgtatggtgcctggctgatttatcccccggcgggttttgttgttgccggggcgctgtgcctgttctggtcgtggctggtggcgcgatatctcgaccgtacacagtcgtctgtcggcggaggtaaatagtgttcttttcgggattatttcaacgaaaaagtgacgcaccggtgaccacgccagcagagctggcggatgccatcgggctgtcgtatgacacctataccggaaagcagatcagcagtcagcgggctatgcgactgacggcggttttttcctgcgtcagagtgctggcagagtcggtcgggatgttgccctgcaatctgtatcacctgaacggcagcctgaagcagagagccaccggcgaacgtctgcataaactgatctccacgcatcccaatggctatatgacgccgcaggagttctgggagctggtggtcacctgtctgtgcctgaggggaaacttttacgcctacaaagtgaaagcatttggcgaagtggctgaactgctgcccgtcgatcccggctgtgtggtatatgcgctgggaaggtgtcagcgatggcctgaaggtgaccgccgggagtgttattcagcgcgatgacctggtgcagtacacgacaactgacgatgcaaccagctccggtggtgtcctgcgcgtgccgatcgcctgctcaagtgcaggtgcggtcggtaacgctgacgacggtacggcattaatcctggtcacgccggtgaatggtctgccgtcttccggtgtggctgacaccctgacaggcggatttgatactgaagagctggaaacgtggcgcgcccgcgtcattgagcggtattactggacgccgcagggcggggctgacggggactatgtcgtctgggctaaagaagtgcccggcattacccgcgcatggacataccgtcacttgatgggaacgggaactgtcggtgtgatgattgccagcagtgacctgattaatcccattccggaagaatcaacggaaacggcggcaagacaacatatcgggccactggccccggtggcaggctctgatttgtatgtgttcaggccggtggcacatacggtggattttcatatccgcgtgacgccggacacaccagaaatacgggctgccattaccgcggagttgcgttcgttcctgctgcgtgatggttatccgcagggagaactcaaggtatcgcgtatcagtgaggcgatttccggtgcgaacggggaatacagccatcagttgcttgcaccggtggacaatatctccattgcgaaaaacgaactggcggtactggggacgatttcatggacgtgacaaacgatgattacatccgcctgttatcggcactgttgccgcccggtccggtgtggtcagccagcgatccggcgattgccggtgcggcaccgtcattaacccgtgttcatcagcgtgcggatgccctgatgcgggagctggatccgcgcaccaccactgaactgataaaccgctgggagcgtctgtgcggtctgccggatgaatgtattccggcgggaacgcagacccttcgccagcgtcagcaacggctggatgcgaaggttaacctggcgggcggcatcaacgaggatttttatcttgcacagcttgctgccctgggcagaccagatgccaccatcacgcgatacgacaaaagcactttcacctgctcatcggcctgtactgacgcggtgaatgcgccggaatggcggtattactggcaggtcaacatgccagccaccaccaactccacctggatgacatgtggcgatccctgtgattccgcactgcgtatctggggtgacaccgttgtcgagtgtgtgcttaacaaactctgcccgtcgcatacctacgtaatttttaaatatccggagtaatccatgcatcgtatagacacgaaaaccgcgcagaaggataagttcggcgcgggtaagaacggttttacccgtggtaacccccagaccggcacgcctgccaccgatctggatgatgactactttgacatgttgcaggaggaactttgcagcgtggtggaggcatccggtgccagcctggagaaggggcggcacgaccagttacttaccgcacttcgcgcgctgctgttaagccgcaagaatccgtttggcgatatcaaatcggatggcactgtgcaaacggctctcgaaaaccttggtttgggagaaggagcaaaactcaatgcagcaacggctacattaggacgcaccggtttcatagctataccggttatgattggtggtattgagcaatcagtaatcattcagtgggggtggaatgccgcaaaagcatctgcctctgggggggatggaaatacagttgtattcccggttgcgtttaataatgcctgtgttgccgttgttgcaaattatgacaatgtcagcgcacctatcaatgcagtggcaacggggggatatacaaccacttcgtttttattacggtgcgcagctcaaacgggtagttattactataactggattgctattgggtattaagatgaaaatatactgttgcttaaataccgttggtttttttatggatggctgtggcgtcattccgccagattctaaagaaataacggcagaacactggcagtcattattaaaatctcaagctgaaggaggcgtgatcgatttttctgtttttcctccttctattaaagaggttatccgtactcatgatgatgaagtcgcagatgcgaactttcaaaagcagatgcttatctctgatgcaactgattttatcaatagcagacagtggcagggtaaggctgcattgggaagacttaaagaagatgagctgaaacaatataatttgtggctggattatctggaagcactggaactggttgatacatccagtgcgccagatattgaatggcctacgcctccggcagttcaggccagatgacatccggcgcggtgctggtatctgttgccgtcaccgcgtcaatgtaatccagcacagcgttaagtctggttgtttctgcctgcgtcagtttacgtccggcctgcaatttcagttgaatcagactaatggaagccattgcagcatcaatcagtgactggcgctgtgcttctgccgcgtctactgcggcgctatgctgtgcttcagtatcggtcacccatttctcaccatcccatttatcgtatggagataaaggggcgatagtggttgtattttcagggtaatcacccggagctttgatttcttttgattctccagttttggtgctatagaccgtttcaccgcgatggtctggcacatattcccatgagttaaaatctgcagaacggcagattgcataaccagccttatgtgtaccaggggcatctaaacaggaacatgccggaatgccgacaccaacggcaagatattcatttgaagtggaaatatattcccgtgtttcaccatcgtagttataaacggtaacatcccctgcctttgttgcaataaggtcactatttaatattgctttatgcatcaggctgccctcacgatatagttaaatgcaatattacgcggacgcgtttctgaggctgcggcacctaaaccatccactgattgtttatatgttttaaaggttccataatccggggctggtaatccggcatcgtttgtgtttcctcttttgataatgtcagtgccactatttacccatatttcatcaaaatagaaattaatcgttgcatcagtcacaatcgtggatcttgacggtaatccatgagcatgatcctccgttgcatacccctgaatacttaaaatagagcgacctgtatcaatcccccgcccgtcatcccagccacgaataaactcaccacgtaaatcaggcaatttatttgtcggataagcctttgccagttccgggtattcttcagcagaaaaagcggcaccattgcatttcagccagcctgttggcggagtggctgaaggccacggaaccgggacaccaacaggtaatgcagagccttctcccaaaccaacgtttatgaaaatgaagaaataacaagcaaatggcatcattcctgcttttaccagggggatttaacatgcttattggctatgtacgcgtatcaacaaatgaccagaacacagatctacaacgtaatgcgctgaactgtgcaggatgcgagctgatttttgaagacaagataagcggcacaaagtccgaaaggccgggactgaaaaaactgctcaggacattatcggcaggtgacactctggttgtctggaagctggatcggctggggcgtagtatgcggcatcttgtcgtgctggtggaggagttgcgcgaacgaggcatcaactttcgtagtctgacggattcaattgataccagcacaccaatgggacgctttttctttcatgtgatgggtgccctggctgaaatggagcgtgaactgattgttgaacgaacaaaagctggactggaaactgctcgtgcacagggacgaattggtggacgtcgtcccaaacttacaccagaacaatgggcacaagctggacgattaattgcagcaggaactcctcgccagaaggtggcgattatctatgatgttggtgtgtcaactttgtataagaggtttcctgcaggggataaataaagttaaagacactttgtgtacaaaagaaagtaaaacaacagcaacttgttgcaattttatcaataaaagtagtattgtcgtgaaaaattgattaaagattaatattatgcatgtttttgataataatggaattgaactgaaagctgagtgttcgataggtgaagaggatggtgtttatggtctaatccttgagtcgtgggggccgggtgacagaaacaaagattacaatatcgctcttgattatatcattgaacggttggttgattctggtgtatcccaagtcgtagtatatctggcgtcatcatcagtcagaaaacatatgcattctttggatgaaagaaaaatccatcctggtgaatattttactttgattggtaatagcccccgcgatatacgcttgaagatgtgtggttatcaggcttattttagtcgtacggggagaaaggaaattccttccggcaatagaacgaaacgaatattgataaatgttccaggtatttatagtgacagtttttgggcgtctataatacgtggagaactatcagagctttcacagcctacagatgatgaatcgcttctgaatatgagggttagtaaattaattaagaaaacgttgagtcaacccgagggctccaggaaaccagttgaggtagaaagactacaaaaagtttatgtccgagacccgatggtaaaagcttggattttacagcaaagtaaaggtatatgtgaaaactgtggtaaaaatgctccgttttatttaaatgatggaaacccatatttggaagtacatcatgtaattcccctgtcttcaggtggtgctgatacaacagataactgtgttgccctttgtccgaattgccatagagaattgcactatagtaaaaatgcaaaagaactaatcgagatgctttacgttaatataaaccgattacagaaataaaattatttattaaagtcacatttaagacgtaataccctacagggtaaaaattttctctgatcttaacttctgcaaatgttaactgctatttttatgctaaaaatggttatcaaaactcaaaaacacatgtttataatcaatgagttatagaaatgctaagggctaatgagttatatgcaaattagtaaaattatgttgctatgtcagatagttacgatttagtcatctaactaatgctgcgccatatgggttggactgaagcggctgacctgattgttaaaggtatggaaggcgcaatcaatgccaagaccgtaacttatgacttcgaacgtctgatggaaggcgctaagctgctgaaatgttcagagtttggtgaagcgatcatcgaaaacatgtaatctctccatgtgttaaatattgaaacgggcgtataacacgcccgttgttttatttatgtggatattattaatagcatatcgagcatatttatatgaagcccattacttgagcccatatgggcatatttttataatgcaactattatgtaaacatttatttgttattttgctttctcctggaggacactcttgactgcttttgagtaaactccataaatccttgttgaatggtgcgatgtgataaatagtaataggatattctttatccttaaggataataccagacttaaccggtgtaaatatactgccaggagggagaaatatagtagattgataccagatgatcattttcatattaccccatatggctgaaaaagatataccacatgtaggttgaattaccgtgtcaattactatccacttcatttgttatgtcttatcccacggtatttaatatggttcattaggatgtttatttcttgattttgcatatgagtatattacccccccctcaaaaaaataaattaattaaaatgatggcttatataaaataaaatttaaagcaaggaatctcaatggatgttaaacaaaatgagattttgtgaaagcaataaattattgacttcgttttagatttgtttagctataatgttatacattcaaatgactgaacatcctgtaattaaaacatagcctttatgctactttgtgccaatttgctaaacattatggttgcctttttatataacgataataatgaatataagcatgacatgagaataaggtttcaatttttgagttatataggaatgatttaacctgttcctggctaaaatacatataaccggatgatgactaaaccaaaatacatgtgcgttaagtattgaaacggacgtgtggcacggccgttgtttttataaatatgttaaccgttataaaataacgtatcaaaagtcaagtgatcacatttcaaatatcaagttgatagtattagtctggtgattatttatgggtgacaataaaaagacagtattaatcatccatagagatagtctctgcacttttatttccattatgctaatgccttactgaattatgaagcatttcttaagtatccaactttagctagattaatggtttattattttctacatcttcaatatataaaagcgtattatcaatggcgtagtaactgcgtttgttatgattaacatcagtaacccaccggaaaacgcccgcgcctgccagtgttgaacagtattcccgaaatgtagattttccgcaaatatgaagcaatgcggcctcttttattttagcagggttcttggtcgtactaacttttaacaggttcctggttcctcttaataacaaaaccgtatcatcgtgagtaataattctgatgttatccgtagccagataataaatgtaatgtgcaatacggtgatgttttaattctgaataaaaccaggagaagttttgctcttttctcacttgctcaaacatcttttgaaaaacaacgacctgatccatcaggataataacctcttgttagttgtgagactgcgtagtgtgcacgatcggttttaccacttcaatctggtctgtcctttggctgtgatatgtacagagtgtgatagagggaatatctgaattctcccggtgagcattttgcaacggaccagctccggtacaaacgctgttgtgggttcagattataacattctgtctaaggggcgggataaaggtgaaattagggggcatgaaagatgactttataaccttgctcaccccagtgttgtaaaagttcgttttgccttctcgttggtgccatgcctgtccagacaatcaatgtttgcgtcgggaacagttccgggcgcggcgattcaatgggatcagcaagaacagaaatgtgccatcctgacaatgataaacgccatgcttccagccacaatcgtgctctctcttcaacattccacgccatcagaatggcttctttaccgggcttacggcgcatttcgaaaagcgaggttgctgcgtattcaattaatgcgccgtcaaacatactgctcataatgcgggaggtgttgtgatcaagcacgagacgctggcgaacaggaaggtaaacatgattaatcaattgatctactgggtactctcgacccagtgaaataattctcgcgcgtagtttggcaggattagccatgcgaagaattgacatcatctcttcttgcaggcggctccagtcatcttccgtatcctggctggtggtttccagtaatgctttaactttgcctacagggacgccattacttatccaacgcttgatctcttcgatgcgttgtatgtcttcttcatcaaagagtcggtgtccgccttcactgcgctgtggttttaacaaaccgtagcggcgttgccaggcccggagagtgacaggattaatcccgcaacgttcagcaacatcaccaatgctgtaataagccacaattcctccttgcggtcacaaatctccgtcgcctgtacacgacccaataatactttgtacaatatacgctaaaattgtacaaagtataaataagatttcagctaaattggatgaaacattatttttaatgtggattaaatttaaacgtaacgtattcattttcacgatgatttactgaaatcatgtgaaagaatgtgctgaaaattattttttctctggccacgctatggaagggataccattcaatttagctttagcaaacagatctccctgaaacatctcaattcctgcggattcaagccacatccactcttctggtgttgccacgcccatagcactgacttgaatttcaagtgatgtacagcattttatgatcgcctgaataattgcctgccgtggcccacttttatgaacattggtaatcaattcctgactgattttaattctgtcaggctggaagcgtgacaggagtaacaaaccagcaaaacctgcgccaaaatgatcaattgctacactgataccagcagcctttagcgatttaatcgcttcggcaaactcatcaaaccgagatatgacttcactttcagtaaattcaacgatgatttgttcaggcaccagagcattggcctttatttcattaagtaaaaaagagactgcgtcaggttcgttaaccagggtcataggtaatagattgattgaaatcattttatcaccgagctcaagtgcgtgtgccatcgtgaatgcaagcgccttacttttgagatccgctgtgtagatttccccgtctttacgctgcccaaccgctatggctgatgggctatcttcatttttttgcacaatggcttcaaaagcgattatccgccgcgataagggatcgacaataggatgaaaggcaaagtggtcgtttatagttggtgaaagggcacaggaatcaagttctttatcagatccgtcagcgataaaaagccaggagtcttcggcagggatctcgaaataggttgattgttcggttgcaaggacaaaagtacgaaaaaattgtagcgctctgtcatcataagttagctgaaattttgatgtgcctttgtcgaatacggcctgtaaaacgtcatctcgctcgtgcaggcgcaaatcaaataattccattcccgctttgccaaaacggcgagcaggcgcgtaatcgcacagcagctcaacaatattatagtgccgtggatcctggcatatagcccgatatatcattttaacctgttcttccggaccttccagaagctggaaaaaatgagaaccattaaacagtaagatccctgttacgtcagactgcatgttcctgcgatttgctatcgaaaccatttcttcgatttttttgacaggttcgtcgtcacgtatatggctacgataaataagggtggtaagcattaacaatccagggtaatgggtgaggcgagagtaagacggtaacagacatatcttcttgtgtctttcttttaataccaaaacataaccgtttctttacattgataaaaaatggaaaaagttgaacactagttggcgaaaaatcttgtatagattgtcagttaaatgatgcaatatgttttatcataacacattgttttatatgcattagcactaattgcaaaaaattaatttatcattctgtacacatatttcgtacaagtttgctattgttacttcacttaacattgattaacatttttaacagaggcgtagcatgcatcaaaattcagtgactttagattctgcgggagcaatcactcgttactttgcaaaagctaacttgcatactcagcaggaaactctcggggaaattgtgactgagattttgaaagatggacgtaatctgagtcgaaagtcgctttgtgccaaacttctttgccgactggaacacgcgactggggaagaggaacagaaacattataatgcactaattgggttgctttttgaataatgcaacagcctgattatttaacaggttagctatgaagtcgttatgaagacatctgataatgaacgtataaaatatgaaattactggccaggcggtgctccagatactgcgcatgaagataaatttttcattgcagactcttattaagcaattactcgtaatgaaatcggctgaggaagatgctttccgacgcgatttaattgacagcataattcgtgattttagcaatagtgattcaggagggccaaaccgaagaacagcgacagctgacaataaaagtatgttcaatggtaagaaaataaacagaatacattaaaatttcataagtaagatgagaggttaccatgcttgaagatactacaattcataatgcaataactgataaagcgttagcaagttactttcgcagttcgggtaatttgttagaagaagaatcagcagtgttagggcaggctgtcaccaatttaatgctttcaggcgataatgttaataataaaaatattatcttaagtctgatacactccttggaaacaacaagtgatattctcaaagctgatgtgattagaaaaacactggaaatcgtgttgcgatacacagctgatgatatgtaacttctaattattaagtataagtttatagaaaactcattcatcttatttttgtctgtcgctttagactatacacagcataattttattgggttaatatttctacgaggctgacatgaataattcaatcccagagagatttatttttcaatgtgctttgtttaaaaatctcgagagggaggtgttcatgacgcatgggtatgttgatagtcatattattgatcaggctttacgcttgcgtttaaaagatgaaaccagtgtgattctttctgatctctatctgcaaatattgcagtacattgaaatgcataagactacactaacggatatcattattaatgacagggaatccgtgctctcttagaacttgagtaaggttttagaataaacatcagctgtatcaccatgctgatgcaaagtgagcatttcaggcgttatgctttcttattatgtccgcaatatcaggtgtcaagaatggagagttctcgctctccattcttgacgcctgatatcccgcctaacttattttgtactgcctacattatgctcaataattaatgggttagatcaagatggagaaaattttatcttcggcgtggatatttcttatgctctctaccatgctctctgtagatgccagcgcgagcgaatgaatggcattttcatgtattaaaccctttggccgggacaagcaaatgcgcaatacactcatacccatcctcgttgcgatatgcttgtttattaccggtgtcgctattttgaacatccagctctggtattccgcaaaagcagagtacctggcgggagcgagatatgccgccaacaatatcaatcatatacttgaagaagcgtcacaagcgactcaaacagcggttaacattgccgggaaggaatgcaacctcgaggagcaatatcagcttggcactgaagcagctctgaaacctcacctgcgcacaatcatcattctcaaacagggaatagtctggtgtacatccctgcctgggaatcgggtcctgttgtctcgtattcctgttttcccggacagtaatttactgttggctccagcaatcgacaccgttaatagattacctatcctgctctatcagaaccaatttgcagatacgcgcattttggttacgataagcgatcagcatattcgtggggcacttaatgtacccttgaaaggggtaaggtatgtattacgcgtggcggatgacattattggaccaacgggtgatgtgatgacgcttaatggacattatccctataccgagaaggttcactccacaaaatatcatttcactattatctttaacccgccgccactctttagcttctacagacttatcgataaaggctttgggattttaatatttattctgttaatcgcctgcgccgctgccttcctgcttgatagatatttcaataaaagcgcaacgcctgaagagatcctgcgacgggcaataaataatggggagatcgtccctttttaccaacctgtggtaaatggtcgggaagggacattgcggggagttgaggtgttagcccgctggaaacaacctcacggtggatatatatcacccgcggcatttattccacttgctgaaaaatccggattaatcgttccgcttacgcaaagcctgatgaatcaggttgccagacagatgaacgctatcgcgagtaaattgccggaaggttttcatattggaattaattttagcgcttcgcatattatttcgccgacgtttgtcgacgagtgtttaaatttccgtgacagttttacccgccgcgatttaaaccttgttctggaagtcaccgagcgtgagccattgaatgttgatgaaagtctggttcagcggttgaacatactgcatgaaaatggttttgtcatcgcactggatgatttcggtactggctactcagggctttcttatcttcatgacctgcatattgattatatcaaaattgatcacagtttcgttggccgcgtaaacgcagacccagaatcaacccgaattctggattgtgtattggatctggcgcgtaaactttcgatcagtatcgtcgctgaaggtgtcgaaacgaaagaacaacttgactatctgaaccaaaattatatcacatttcagcagggttattatttctataaacctgttacatacatcgacctggtcaaaattatcctttctaaaccgaaggtgaaggttgtggttgagtgaaaattgatcagtaaggccatagtgcggtgtaattatagacagctaattagctcgttgcctcttgttactattgttcattattttgtttgctataattgtttgaaagttttgacaggattgccattagtagcatgaacaatagtaataatctggattatttcactctctatatcatattttccattgcatttatgctgatcaccctcctggtcatccttattgcaaaacccagtaccgggctgggagaagtgcttgtgacgataaatttgcttaatgcccttgtttggctggcgatcaatctggttaatcgattaagagaaagactcgtcaaccacagggatcagcaataatctttcagtttctcactgtcagtatgcggctgaatgggttgctggcagtgaacgcctggatcattgaaggaaaggcattattgcgcaaatagttgtcaaccctggtgttatcacggttgtttttatatatcaccgaaataatcctcatcgcaactattaacaattttgatgtcgaagagttatttgttaaacaaaatcgtcacctcaaagtgatcaatgtcatgaaaataaggtgaaaaatgataatgccgacttatttatcatttatatattgtcgctgtttatctatttaaattttttgtgcttttgtttttgtctttaccctccgttttggtaatctgagctcataggttatttgaccaggaatgtttgttaatccaatgaatggatggttaatctatgaaactgaaaaaactccccgggtttagtttgggacttattgctctggcggtgggtaatgcatatgcaacacaattgttggatgattatagtataatttcctatatgactgatgaagaatcgccgattgaaatcaaagataataatccgataagtaatggagagtatctaaccactgaagacgaaagccatgctgtgaaagtggatgacggtgtaactggatatataaataatgccagtgtgatgactagtggtgatggatcttatggtatttctgttgatagtcaaaacaaagtattatatataagcgatagcgatattaagacctctggaagcgtatctgacaaagaaaatggagggataacagccagcgcagtagtcagtgaatttggtggcaccatctttatgaatggtgataattcagtcgagtcgggtggggcatattcagcgggacttttaagccaggttaatgattctgaaaagatggtaaataacacccgtcttgaaaccacagataaaacgaacattgttacctctggggaaaatgcagtaggtgttcttgcatgttcaagtcctggagagtctcgaacatgtgtcgatgctgtagatgatgaagttagtgattctaacagttacgaagttattagccgtgctgatttaaaaatgaatggtggttccataacaactaatggcattaatagctatggtgcttatgctaatgggaaaaaagcatatattaatttagattatgtggcacttgaaactgtggctgatggaagttatgcagttgctattcgacaaggtaacattgatataaaaaatagttctattacaacaacaggcactaaagcccccattgcaaaaatatacaatggtggagagttatttttttccaatgtcaccgcggtatcaaaacaagataaaggaatatcaattgatgcatcaaatatcgattctcaagccaaaatagcactattaagtgttgaactttcaagtgctttggatagtattgatgttaacaaaactacaacggatgtaagtatccttaatcgaagtattatcacacctggtaataatgttctggttaataatactggaggtgacttaaacataatttcgtccgactctattctaaatggagcgactaaactcgtcagcggcacaaccacgctgaagctttcagaaaatacaatctggaatatgaaagatgactccgttgttacccatctgactaattcagacagtattatcaatctttcgtatgatgatggtcaaacatttacccaaggaaaaacattaaccgtaaaaggtaattatgtcggtaataatggtcagcttaatatccgcaccgtattaggtgatgataaatcggctacggacagacttattgttgagggtaatacttcgggttcaactaccgtctatgtgaaaaatgctggaggaagcggcgcggccacgctaaacgggatcgaactcataactgtgaatggcgatgaatctccagcagatgccttcagataaggtgatgcaaggattgcagctggagctttcgaatatcaactaaaacaacaaggcaaaaactggtatttgacaagttatcagtcagtgaatgaggaggataacagctcagagggaaattcagaatcaacagaaacgcctacccccgtcctgcgccccgaagctggaagttacgtcgctaacctggcagctgctaacactctttttgttatgcgtctgaacgaccgtgcgggtgaaacgcgctacatcgatcctgtaactgaacaggagcgttcaagccgactttggctacgtcaaattggcgggcataatgcctggcgtgacagcaacggacagttgagaacgacctcgcatcgctacgtctcgcagttagggggcgatctgttaaccggtggttttaccgatagtgacagttggcgtttgggagtgatggctggttatgcccgcgactacaacttaactcattccagcgtgtcggattatcgttcgaaagggagtgtcagaggctatagcgcagggctgtatgccacctggtttgccgatgacatcagtaaaaaaggcgcatacattgactcctgggcgcaatatagctggtttaaaaactcggtgaaaggggatgaattagcctatgaatcctatagcgcgaaaggtgcaaccgtctcgctggaagcgggttacggttttgccctgaataaatcctttggtctggaagcggcgaaatatacgtggatcttccagccacaggcacaggctatctggatgggcgtcgatcataatgcgcacacggaagccaatggctcacgtattgagaatgacgcaaataacaacatccagacccgactcggcttccgcacctttattcgtactcaggagaaaaacagcggtccgcacggtgacgactttgaaccttttgttgaaatgaactggatccataacagtaaagattttgctgtctcaatgaacggtgtgaaagtcgaacaagatggggcgagtaatttgggggaaattaaacttggcgtaaatggcaacctgaatccagcggccagcgtctggggaatgtgggcgtgcagctgggtgataatggctacaatgacaccgcagtgatggtgggcctgaaatataagttctgatcccgccgttagctaaaaaaccgcgtcgtattcatcgacgcggtacatatgaaatattattttttgccgatagcacgcatggtgtcatcaattgccgtgatcaacagcatttgcgggtctttagcgcaaacctgattcagtttttctaccactttggcgctcagttccggagattgctcaatttttaaatcacggctggcaacgctggcattacccattaccgcaacaatttctgcaacctgtgcgctgtcagtttttgccatttcgttggcttctgcgcaagtaatataggtttctgacggcaaaccgtttttaatattgtagtcctgcgcccaggtcattggtgcgaaaacaaacaggcccgccagtaaagcaaattttttcatcatcattccttatttcattttacccagaattgcaccacccgtaccgccaatcacggcacctttaatcgccccttcgaggccattgccggtcagaacgccagtgacagcaccaacggcggcacccacttttgcacctttacgcgcatttttaccgtcgcggcctttttctgttactgcaccaacaccagcgccaacagctgcacctttcagtacgccattaacaccattgccagtaagtaaaccaacgcctgcgcctagcaatgcacctttcgtggtgcggttcatatccgccatcgctggcgtggagcagaacaatgctgagataagcccgaaggcaagtatttttttcttcaacttagatgtccggtattaagtaagttgcacacacaataatttcgtcttcaattaagatctgcttaactaaagaacgctcgctattattcagataattcaaaatgagcgtggctgtgatgataggaattatgttttttacgtgaatgagaataatcttaaatgaggaataactcattgattgacaatatttttattcaagaagtgtcattgactgttaacgcaatgttgtaaaggtaagataatctgatttatcaatattattgtgtgatttttatgtgagcagaagatattcatcagcaacgattacattagtcattttattttgccgacggcctcattgtcgaaagataagcgtacgacagtattatcagaaaagagtgattttttatccaactacacttcagcgcactgcgtgtaaaaaatgcctctttcttatgcgggatatcatcatttcatcatgatgtctttggtgagcggtgaacacaatacacctgcgctgtctcttcaggatgaatcccctggtctggtgcctgcgggctgatgttgcagcagagcttaggtcacttagacgctactatcatttatccaatggcatggaatcgaaatcagtcgatacccgcagtatatatcgtgaactgggtgcaacgctgagttacaacatgcgcctggggaacggtatggaaatgaaccctggctgaaggcggctgtgcgcaaagaatttgtcgatgataaccgggtgaaggtgaataatgacggtaatttcgtcaatgatttgtcgggcagacgtggaatataccaggcagctattaaagcctcattcagcagtacgtttagcggacatctcggggtggggtatagccatggtgccggtgtggaatccccgtggaacgcggtggctggtgtgaactggtcgttctgaccatcaacgattaaactgcgcttcggcgcagttttcgtttacaggatgttgaaagggaaaattctggggcaaaaaaagcccgccagttacggcgggaaacctcatcctatgggagaacaatgaataatgaaattgcggggttatcatctcccagtatatccatactaacaataaggttatttactcaaccaggcataaacattttgttttgtgcgtgggaacagccttaaggtgtaaagggggaggtggaaatagcaatgaggagtatcagcaagaatactcgccgctttaccacaacgtggatgagagggatgaaaaactcaaggcagagataactctgccttgaagataaatgcgcttttacagcgggcttatttcagctcttctgcttccggtaaggtcacgttcagctcaagaatagaaatatcgccatctttttgctcaagctgtacggttaccatctcaggatcaatttgtacgtatttacaaatgacctcaagaatatctttacgcaactgcggcagataatgcggttctgcatcgctgcgacggcgttcagcaacaataatctgcagccgttcttttgcaatgttggctgtgtttttcttccgcgagagaaagaaatcgagtaatgccataacttatcctccgaacaagcgtttgaggaagcctttcttctcttcttcaatgaagcggaaaggacgttcttctcccaacagacgttctacggtatctgcgtaggctttacccgcatcggcgttaatgtcgagaatgaccggttcaccctggttagaggcgcgcaatactgattgatcctctgggatcacgccgacgagtttgatgcgcaggatctccagcacatcttccatgctcagcatgtcacctctgcttacgcggcctgggttatagcgcgttaacagcaggtgctctttaataggctcttcgccattttctgcgcggcgtgatttcgacgccagaatgcctaaaatacggtcagagtcgcgtactgaggagacttccgggttggtggtaataatggcttcgtctgcaaaatagagtgccattaacgcaccggtttcaatccctgccggggagtcacaaacgataaattcaaaatccatcgctttcagatcatcaagaactttggcgaccccttcacgggtgagggcatctttatcgcgtgtttgcgatgccggcagaatatagagattttcagtacgcttatctttaattaacgcctgatttagcgttgcatcgccctgaatgacgttgacgaaatcgtaaacgacccggcgttcacaacccataatcaggtcgagattacgcaggccgatatcaaaatctatcacgacagttttctttcccttctgggccaaaccagtggcgatggccgcgctggaggttgtcttaccaacaccccctttgcccgaagtaacaacaataatgcgtgccatagaaattccttgttaaaaagggatcaatttaacggttgaacggtcaaagcgttttcgactaactgcagtcgcgccgctttgccataaaattctgctgggatttgatcactcagccagtattcacctgcgatggacaccagttccgccatcaggttcgtacaaaatatttgcgtttcccggtcaccacttgcccctgccagcgcacgaccgcgcatcatgccatagacatgaatgttcccatcggcaatcaattcggccccagcgctaacgtggcttgtaacaatcagatcacattgtggagcataaatacgctgaccggaacgcaccggggtatctattaaacgcgtttttgtgaccggcgttgtattttgcgctggagcctgcggtgtgggagctggacgtggcgctttttcctttccttccgtcaggataggcagccccatcttttcaatttcggctttaagttgcgcatctttgcagccacttacgccaataacccgcaaaccggttgccgaaaccgccttatgcatcgctgaccagtttaccgggtcttccagtgcactgacgttgagtacaacgggggcatgttttaaaaatgcgggggcctgagcgattttgtcttccagcgcctgatggataaccttaggttctgcctcatgcagatgaaccacagataaagtgaagctactgcctttaagctcgattggcgtgtttgacatcctggccttactcaattagctattaatcatcgccagcgcgcgatgatgttccgaagactataaggcatgttatagtctggattatattgaggcaagtcaccctcccatttattcagagtaaaagtctattctgtgataaatggcgctgattcatagcttaaaaaatacccttgtcaatcaacccattgccgtcgtacttttgattgttcttatttacgcttcctttttccgcaccctaatcgtgacagcatctccagacctgtttaaatatccagtattgaggcaagtgtattttttcaccacgccaggctttcttaactttccattttttgcggcatcattaaagaacagatacccgttatcttaatatccgccacagaattgctctatcatagaaaccgcagaagacgtctgatacttctgtcaggtcatcgtaactcgtccaggtcagcggttttgattacggattgatgatgaaatgagcataagtgttgtacggttggattatcaggatgtgctatgaatatgatgcgtattttttatatcggattgtcaggtgtggggatgatgttctcatcaatggcgtctggaaatgacgctggcggacttcaatctccggcgtgcggcgttgtttgcgacccgtatatttgtgtgaactcagatggcatttccccagagttaacaaggaaatatctcggcgaaaaagccgctgaaaacttacaatcattacaaggctacgatcccagcgaatttacattcgctaacggtgtattttgcgatgttaaagaaaaattatgtcgtgatgatcgttattttggtgtggatggtaagcggagtggaaaaatcaatcaaaccaccacaaagatgttatttatgtgtcgtgagtgatgtcttgtttacattatgttctattcgtcattaacctcttgagcgacagagaggagtggggcattaacgtttatgacggggagagtccccgtcggttgacatttacttaatttgaatatcgacgttatattttttagttttgtttttacgggcgtcgtttcgggtttgcaacactcgcagctcatatttgccagaagcagggagtgagtattgtccgtgactatcgagttctggggaatatctggataaatcaactgaatcatcgattcctggcccgaagaggtaagtatcagcgccttcattagagatactcacatgcactttctgaccttttttggcatagaaggtatatgtatcgtaatcgtatccctttatttcgccggagtactgagcgctgctatggccttttctgaactcaacattgacattcttacccgcagcaaagctcgtggaggttagcagtgcaagcagcaatacagccttcctgatgctcttgattttcattggtagtctcctgttcagaatgagtacgatgaactgttataatataacaatccctaacgggagaattccagtggctttcctgcgttcggtaaaatcacgttgcggcatttttgccggggggattacttataaagggggcatggactcaacaaaccgtagaaatctacagctggctggcttgtggcgcgggtttcattgatgttagcttatgccaaaacctggcatcttaaagagtaaaagtatgttttgtgtgatttatcgaagcagcaagcgtgaccagacctatttatatgtcgaaaaaaaagacgatttttcgcgtgttcctgaggaactgatgaaaggttttggtcagcctcagttagcgatgattctgccgctggatgggcggaagaaactggtcaatgccgatattgaaaaggttaaacaggcattaaccgagcaaggttactatttgcagttaccgccaccacccgaagatttgctgaagcaacatctttccgtcatggggcagaaaacagacgacactaacaaataaccgatatccggcggtggcattatctttgtcggcgcgggttttcatatccacgataaggtgaggggaacgttatgtatcaacatcacaactggcaaggtgcgctgctggattatccggtgagtaaagtagtctgtgttggcagtaactatgccaaacatattaaagagatgggcagcgcagtgcccgaagagccagtgctgtttattaaaccagaaacggcactgtgcgatctgcggcagccattggcgatcccatccgatttcggttcagttcatcatgaagtcgaactggcggtgttgattggcgcgacactgcgtcaggctacggaagagcatgtccgcaaagccattgccggttatggcgtggcgctcgatctgacattgcgtgatgttcagggaaaaatgaagaaagccgggcagccgtgggaaaaggctaaagcgtttgataactcttgtccgctttccgggtttattcccgcggcggaatttaccggcgacccgcaaaatacaacgctgagcctgagcgtaaacggcgaacaacgccagcaaggtacgactgcggacatgatccataaaatcgttccgctgatcgcttatatgagcaagttttttaccctcaaggccggtgacgttgtgttgacaggcacgcctgatggcgtcggcccgttgcaaagcggtgatgagctgacagtcactttcgatgggcattctttgacaactcgcgttttgtaatactttttgccgcctgaaagcggcggcaaaacttgcatcgctgtgccagactggttataaggtgcgttttaacgtaatggcggaacacctgatgagcgatgtacctttctggcaaagtaaaaccctggacgaaatgagcgatgcggaatgggagtcgttgtgtgatggttgcggtcagtgttgcctgcataaactgatggatgaagacaccgacgaaatctacttcactaacgtcgcctgtcgccagctcaatattaaaacctgtcaatgtcggaactacgaacgtcgtttcgagtttgaacccgactgcattaaattaacccgtgaaaatctgccaacattcgaatggctgccaatgacctgcgcttatcgtttgctggcggaaggtaaagatttacctgcgtggcatccgctacttactggttcgaaagcggcaatgcatggtgaacgtatctctgtgcgtcatatcgcagtgaaagaatcagaagtgattgactggcaggatcatatcttaaataaacctgactgggcgcagtgataaatttaatagatgctgatgggggctttcttaatatacgtctggatgctcgccatttcgtagccctgtttttgaaagcgctctgtcataatgagagttacccgataccttattatcaacaggtaactctcaatctttaaaaaacgtctgtgtttttaaatgtgataaaccttataccttgagtacatggagagaataatcgcttatcagacttcaggtacctcaaagagtgtctttttaccgtgtcttttctgatactcattacaggtgttaatcatttttttggccgcttcttttagcaaagaaagcattaaatcatcataatcaacgtagaatctggttgtttcagtttccgtttttatctcaccgatggcggctatttcggtggttaatttcaatttggcggcatcgatatctttattcgcttgtttaaccgtgttagacagggtggtaaagaaattctgcacagattttaacttgttcttcaattctggaatcagttttccttcaactacgcccgcagcaatagaataggaaatgattaatccaaatggaccggcgacgacaccggctgcggcaccggcatatgcttccttcctgattttatctacctgtgactggaaatagctgcttttttctgaaaaatcattggttaactggctatctaacgccagcagtttcccggaagcgttgttgaaactttgtgagcttaccagcagggatttttgcgcttcattcagcttcgtgatgccgtcatccagtaccttaatgagaatgtctttctgggcggatgctttcttctcattgtactcatcaaatagcaaaatatacgctgcgagcaattgcgtcgcaacaccacaccattcatacactgtttgggttgcttcaaaatacttatcctggctatccataagtaaggttttaatatcgccgactaaaacggaggctgcctgtgaatactcctgtttaaagcgacttaactcttttatggtttcatcaaaggtctgccaggggatgacctgatcgagatatttattataaagatctaatgctccatctgcggtttcgattgcgtttttaactacttctaccgttttatctgcaacgatttcagtcataatcattcgcctctttaaatatataaattgtaatgaaactcctgttttacaactattaataaattttacttcatctaattcatagttagccgggcgggatgcgtcaatgtctttatttctattaatatgataaatatcaaacaatgtttaatgtcattatggcgaatgcttctattctattttttagccgggtgatatttttcatttctgctggatgagcgtcgtcgccagaaggccacgtgagcacaagataagagaacgaaaaatcagcagcctatgcagcgacaaatattgatagcctgaatcagtattgatctgctggcaagaacagactactgtatataaaaacagtataacttcaggcagattattatgttgtttatcaagcctgcggatctccgcgaaattgtgacttttccgctatttagcgatcttgttcagtgtggctttccttcaccggcagcagattacgttgaacagcgcatcgatctgaatcaactgttgatccagcatcccagcgcgacttacttcgtcaaagcaagtggtgattctatgattgatggtggaattagtgacggtgatttactgattgtcgatagcgctattaccgccagccatggtgatattgtcatcgctgctgttgacggcgagtttacggtgaaaaaattgcaactacgcccgacggtacagcttattcccatgaacagcgcgtactcgcccattaccatcagtagtgaagatacgctggatgtctttggtgtggtgatccacgtcgttaaggcgatgcgctgatgtttgccctctgtgatgtaaacgcgttttatgccagctgtgagacggtgtttcgccctgatttatggggtaaaccggtggttgtgctatcgaataatgacggttgcgttatcgcccgaaacgctgaggcaaaggcgcttggcgttaaaatgggcgatccctggttcaaacaaaaagatctgtttcgtcgctgtggcgtggtttgctttagcagcaattatgagctttacgcagacatgagcaatcgggtgatgtcgacgctggaagagctatcgccccgcgtcgagatttacagtattgatgaggcattctgcgatctgacaggtgtgcgtaattgtcgcgatctgactgattttggcagagaaattcgcgcaacggtgctacaacgtacccatcttactgttggtgtggggatcgcccagaccaaaacgctggctaagcttgccaatcatgcggcaaaaaaatggcagcggcagacgggtggggtggtggatttatcaaatctggaacgccagcgtaaattaatgtctgctctccccgtggatgacgtctgggggattggacggcggatcagcaaaaaactggacgcgatggggatcaaaaccgttctcgatttggcggatacagatatccggtttatccgtaaacattttaatgtcgtgctcgaaagaacggtgcgtgaactgcgcggcgaaccctgtttgcaactggaagagtttgcaccgacgaagcaggaaattatctgttcccgctcgtttggtgaacgcatcacggattatccgtcgatgcggcaggccatttgtagttacgctgcccgggcggcggaaaaacttcgcagcgagcatcaatattgtcggtttatctccacgtttattaagacgtcaccatttgcgctcaatgaaccttattacggcaatagcgcgtcggtaaaactgctgacgcccactcaggacagcagggatatcattaacgctgctacgcgatctctggatgccatctggcaagcgggccatcgttaccaaaaagcgggcgtgatgctgggggatttcttcagtcagggagtcgcgcagctcaatttattcgatgacaacgcaccgcgccccgggagtgagcaattgatgacggtaatggatacactgaatgctaaagagggcagaggaacactctattttgccgggcaggggatccagcaacaatggcagatgaagcgagccatgctttcaccacgttatacaacgcgaagttctgatttactgagggtcaaataaatatagcggcaggaaaaaagcgctcccgcaggagcgccgaatggattagcgaccgaacagatcacgttttttcgctttaaacggctgggaaatcaccaccagcactgcgacaatcaggtaagcgataaaaataccgagcagccactgcggcatttccagacctaaaaaatcccactgacgctcggcgcaatcgccagaggcgacaaacacttgcggcacccacttatccagcggcagccattccgggaaacgaaccataaaatcacaggtggcaaacggcgaaggatagagctgaagcatggtgtgctcgtaagttaactgcacaccgcggaacgcactatacaaccagataaccatcgctacataacgcagcggagttttcggggcgatcgcgccaatcagcgcagcacccagaacgccgaataacgcgcagcgttcataaatacagagcacgcaaggtttcagtaacatcacatgctggaaccacagcgccgtcagttccagtgccagagcagtaaacgccatcaacagccacgcgccccggccttgtgaacattggttcaaaaatcgcaacataatcatttccctgcaatatgcatagagtgcgcagtttaaaccaattcattcgctgcgccaccaggaggcagcaaaaataggacgcaattggacaattatcgggcgaaaaggcaaaccgggcatttatatgcccggtaagttgttatcaaagcgttgctatccagcccatttgcataaaccattcggttacaggggcaagcgtaaactcgacgcagagcaagccgacgagtgtcaggacgagggtgtaaggcagggccatccacaccatgcggccataagagaggcgaatcaatggcgcgagtgcagaggtcagcaggaacaggaacgcagcctgaccgttcggcgtagcgacggagggcagattggtaccggtattaatggcgaccgccagcagctcgtattgcttcaacgtgatagcgccactttccattgccgctttcgcttcgttgatataaatcgtccccacgaagacgttatccgaaatggatgacagcagaccgttgaaaatatagaacagcgacagctgagcatgttccgatgcctgcaacacaaactgaataattggcgaaaacagttgttggtcgataatcaccgcgactaccgagaaaaacaccgtcaacagtgcggtgaatggcagagattcggtgaaggctttaccgatagcatgctcatcggtgacaccggtcaatgatgttgccagaataatgactgacaaaccaatcaagccaacttccgccagatgcaacgccagcgcagtcaccagccagacgccaataatcgcctggacaatcagacggattttatcctgacgggtacgctggtggcggctttgatcgtcaaactgttgcaacacttcgcggactttctccggcagcgtttcaccgtagccaaaccaacgcagcttctctaccagcaggcaggttaacaggccacaaatcagaaccggaacggtcaccggcgacatgcgcaggaagaaatcgccaaaatgccagccagccgctttagcgatgatcaggttctgtggttcgcccaccatggtcattacgccgcctaatgcggtgccgacaccggcatgcatcatcaggctacgcagaaagccacggaactgttccagaaccactttgtaatgcttgtcgatatgactatcgtcttgcaggtcggtgtcttcggtacgggaagaggctacgcggtgataaataccataaaaaccgactgcaacgctgatcaccaccgccacgacggttaaggcatcgaggaacgcggagaggaacgcagccgccacgcaaaaagagagcgacagcagcattttggagcgaatgcttaacagcaaacgggtaaatatgaacagcaacagctgtttcataaaatagatacccgccaccataaacatcagtaacagcaagacttcaagatttgccgccacctcttcacggacgtgttccgcgctggtcatgccgatgaataccgcttcgatagccaacagaccaccggggagcagcgggtagcatttcagggccatcgccagagtgaaaataaattccgctaccagcaaccagcccgcgacgaaagggctgatgaggaaaattaacgggtttacgattaagaaaatgatgagggcgagtttgtaccagtcgggggactggcccaaaaaattgcgccatagcgcgcggccccaggagatctccatgatggtttcccttaccttacaaataatcaatgatgtttttatgtttaaacgcaaagcttaacggtcaggcaggagtgaggcaagtcttgatagtcaaggggaaagagatgcggaaaatgaagccttgatccctttttcttctttttgtctgctatcagcgtagttagccctctggtatgatgagtccaactttgttttgctgtgttatggaaatctcactatggtcattaaggcgcaaagcccggcgggtttcgcggaagagtacattattgaaagtatctggaataaccgcttccctcccgggactattttgcccgcagaacgtgaactttcagaattaattggcgtaacgcgtactacgttacgtgaagtgttacagcgtctggcacgagatggctggttgaccattcaacatggcaagccgacgaaggtgaataatttctgggaaacttccggtttaaatatccttgaaacactggcgcgactggatcacgaaagtgtgccgcagcttattgataatttgctgtcggtgcgtaccaatatttccactatttttattcgcaccgcgtttcgtcagcatcccgataaagcgcaggaagtgctggctaccgctaatgaagtggccgatcacgccgatgcctttgccgagctggattacaacatattccgcggcctggcgtttgcttccggcaacccgatttacggtctgattcttaacgggatgaaagggctgtatacgcgtattggtcgtcactatttcgccaatccggaagcgcgcagtctggcgctgggcttctaccacaaactgtcggcgttgtgcagtgaaggcgcgcacgatcaggtgtacgaaacagtgcgtcgctatgggcatgagagtggcgagatttggcaccggatgcagaaaaatctgccgggtgatttagccattcaggggcgataatcccttccgtttaaagagcaaacccctcaaacgaggggttttttgttgtttttacagatttcccattcttggcgggcaacgttccagcaactcgatgctgccgtcttcgttttgctgttcgagcatcacatcaaatccccacaggcgatgcacatgcttcaggacttctttgcgcccccgatccagcggtgcgcgattatgtggaatataacgcagcgtcagcgaacggtcgccgcgcaaatccacgttccagatctgaatattcggctccagattacttaagttatattgcgacgataaccggttacggatctcccgataaccttcttcattatgaatagcggaaatctccagataattatgccgatcgtcatccagcacggtgaagaagcggaaatcacgcatcactttcggtgacaggaactggctgataaaactctcatctttgaaatcacgcatcgcgaaatgcagcgtttccagccagtcggaaccggcgatatccgggaaccagtatttgtcttcttccgttggcgactgacaaatccgtttaatatcctggaacatggcgaacccgagggcatacgggttgatgccgctgtaccacgggctgttataggggggctggaagaccacattggtgtggctgtgcaaaaactccagcataaaacgttccgttactttcccttcatcatacagatggttaaggatggtgtagtgccagaaggtcgcccagccttcgttcatcacctgagtctgtttttgcggataaaaatactggctcaccttacgcacaatacgcaggatttcacgctgccatgattccagcagtggcgcatttttctccataaaatagagcaggttttcttgtggttcggacggatagcggcgcgcttcagcaaccgttttctcttcctcgcgcttcggcagggtacgccagagcatattgacctgactttgcagatactcttcgcgacttttctgccgggctttctcttcttgcagcgagattttttgcgggcgtttgtaccggtccacgccgtagttcatcagcgcgtggcacgagtccagaagccgttctacttcatcaacgccataacgctcttcgcactcggtaatatatttacgggcaaaaatcagataatcgacaatcgaactggcgtcggtccagctacggaataagtaattgtttttgaagaaagagttatgcccatagcaggcatgagccatcaccagcgcttgcatggtaatggtgttctcttccatcaggtaagcgatacacgggttagagttaatgacgatttcataggccagtccttgctgaccgtgcttatacagccgttcagtctcgataaactttttaccgaatgaccagtgcggatagttaattggcatgccgacgctggagtaggcatccatcatctgttctgaggttatcacttcaatctggtgcgggtaggtatccagccggtagagtttcgccacccggtctatctctgccagataaacatccagcaggtcgaacgtccagtcgggtccatcgctcaaacgtgtggtgtccttattcatagaatcgatcgtcgccatacgcgcacctcattgttgtcggcgctctctgtgtggagcacctcatttcaagcatagaacacctgttaaaaaccgcgtcgccggagaatttttttctttgcgatttcttattatcagagtgccactaatccgcttctgaacggaattttatgctggataaaaagggcgttcagcaggagatactaaagacgccatattgccgcagagtcagggagatgtgagccagctcaccataaaaaagccgcatgttgaataatattttcaactgagttatcaagatgtgattagattattattcttttactgtatctaccgttatcggagtggctatgcgagttgtcatactgggaagtggtgtggtaggcgttgccagcgcctggtacttaaatcaggcaggacatgaggtcaccgtcattgatcgggagccgggggccgccctggaaaccagtgccgcgaatgccgggcaaatctcccccggatatgctgcaccgtgggcggcaccaggtgtgcctttaaaagcgattaaatggatgttccagcgccatgcgccgctggcggttcgtctcgacggtacgcagttccagttgaaatggatgtggcaaatgttacgtaactgcgacaccagccactacatggaaaacaaagggcggatggtgcgtctggcggaatacagccgtgattgcctgaaagcattgcgcgccgaaaccaatattcagtatgaagggcgtcagggtgggacgctgcaactgttccgtaccgaacaacagtatgaaaatgcgacccgcgatatcgccgtgctggaagatgccggcgtaccgtatcagctgctggaatccagccgcctggcggaagtggagcccgcgctggcagaagtggcgcacaaactgacgggcggcctgcagttacccaatgatgaaaccggagactgtcagctatttacccagaatctggcgcggatggcggagcaggcgggggttaaattccgctttaatacgcccgttgaccaactgctttgcgacggcgagcaaatctacggcgtgaagtgtggcgatgaagtgattaaggccgatgcgtatgtgatggcgtttggttcttactcgacggcgatgctcaaaggcattgttgatattccggtgtatccgctgaaaggctactcgctgaccattccaattgcgcaggaagatggtgcgccggtatccaccattcttgatgaaacctacaaaatcgccattacccgtttcgataaccgcattcgtgttggcggaatggcggagattgttggttttaataccgagctgttgcaaccgcgtcgtgaaacgctggagatggtggttcgcgatctctatccacgcggcggtcatgtcgagcaggcgactttctggactggtctgcgcccgatgacgccagacggcacgccggttgtcgggcgtacacgctttaaaaatctgtggctgaataccggtcacggcacgctcggctggacgatggcttgcggttccggtcagttgttaagcgatctgctctctggtcgcacgccagcgatcccatatgaggatctaagcgtagcgcgctacagccgtggatttacgccatcacgtccgggccatttacatggcgcacacagctaaggaaacgagatgacccgtccgatacaggccagcctcgatctgcaggcattaaaacagaatctgtccattgtccgccaggccgcgacgcacgcgcgcgtctggtcggtggtaaaagcgaacgcttacgggcatggtattgagcgtatctggagcgcgatcggggccaccgatggctttgcattgcttaacctggaagaggcaataacgttacgtgagcgcggctggaaaggaccgatcctgatgctggaaggatttttccatgctcaggatctggagatttatgaccagcaccgcctgaccacctgcgtacacagcaactggcagctcaaagcactgcaaaatgcgcggctaaaagcaccgttggatatttatcttaaagtgaacagtgggatgaatcggttgggcttccagcccgatcgcgtgcttaccgtctggcagcagttgcgggcaatggcgaatgttggcgaaatgaccctgatgtcgcattttgccgaagcggaacatcctgatggaatttccggcgcgatggcgcgtattgagcaggcggcggaggggctggagtgtcggcgttcgttgtccaattcggcggcgactctgtggcacccggaagcgcattttgactgggttcggcctggcattattttgtatggcgcttcgccgtccggtcagtggcgtgatatcgccaataccggattacgtccggtgatgacgctaagcagtgagattattggtgtccagacgctaaaagcgggcgagcgtgtgggctacggcggtcgctatactgcgcgcgatgaacagcgaatcggcattgtcgccgcagggtacgccgacggttatccgcgccacgcgcctaccggtacccctgttttagtggacggcgtgcgcaccatgacggtggggaccgtctcgatggatatgctagcggtcgatttaacgccttgcccgcaggcgggtattggtacgccggttgagctgtggggcaaggagatcaaaattgatgatgtcgccgccgctgccggaacggtgggctatgagttgatgtgcgcgctggcgctacgcgtcccggttgtgacggtgtaacttgttgtaagccggatcggaggcaacgtcttctgggtgcaaaaaaatcatccatccggctggtcagcaactgtagttgttaatgtgacagagccattgcccatgatagtgtccattaaaaggatggacactatttccccggaacctgaactcaccgcacaggcgttctacataaaacgcttacgcttcattgttgactcgaactcgacttcagataaatcacgctttacccttgatggagcctgtacatagatttgtgtaattgcctgattttgatatgttcaattcaacatcaaatgaaggttaaattatggacgacaaacaattgcaggctcaggctgcgttcagcaaagcatcgcaaccggcgatagatgcttcattaaatttaagattcagcttcctcttcagccacccgtacgccaatcttcaacacttcattatcttctttctcggccaccgtccagatcatcccggcaaactctacctggtcaccgacaaccggtgccgcgcctaacaactgctggacaatttcacccagcgtttgctgcttatcacgatattctcgcccgtcttccaggccatatatcagcgcaacatcagcatatttggcgctggcttcgagaatgaagtcaccaaagaagcgttgatccagcgcgaccggcggcgactggctgaacagtttaccgagcgccggaagatcgcgttcccgaccaattacacacaacacatcgccttcgcgcagtcgggtgctgccggtaggatgaagcaactggttatcacgaaacagtgccgcaatacgcgtctcttttggcatatgcaaatcgcgcagtgccgcgcccacgcaccatttatcggcactcaattgataaacaaactgctcccacggattttccggatgaatatccaggccaacgcgtgacaccggacgtcccactggcggaaccaccactttggcttttttagccgcccacgagagtgatgttccctgcaagagcagtgaaaccagaaccacaaagaaggcgacattaaagaacagacgtgcattctccagccccgccatcatcgggaacacggccaggatgattggcaccgcgccgcgtaatcctacccagctgataaacacgcgctcacgcagattgaaaccgcggaaggggagcaatccagcaaataccgaaaggggacgggcgaagaatatcatccatgcggacaaaatgagcgccggaatggcaataggcagcagatcgcttgggttaaccaacagccccagcaccaggaacatggcgatttgcgccagccaggcgaggccgtcgaaattttgcaggatgccgtagcggttgcgaatagggcgattacccagcagaaaaccgcacagatacaccgccagaataccgctaccttccagcgcagtagttaatgagaaaatcagaataccgccacttaatgccagcaatggatataatccggcgggcagggcgatgcggttgatcatttgcagtagtaaataaccgccgccaagacctattacaatgcccagaccaaattgttgcagaatatcgacaatgaacatccagctaatattgctctcatgatgctggatcatcgcaattagggtaatcgtcagaaagaccgccattggatcattactgccggattcaatttccagcgtcgagccaacacgttcgttaagccccttaccacccagcagagaaaagaccgctgcagcatcggtagagccgacgatagcgccgattaataagccttcaatcaaatcaagattaaacagccacgccgccatcatgccggttaaaccagaggtgataagcacgcccagcgtcgccagcgacagtgccggtcctaacgccacacgaaaggaactggcctgagtgcgcatcccgccgtcgagcaaaataatcgccagtgccaggttacttaccatgtaggcgaaggggtaattatcaaacgggataccgccgacgccatcgactcctgccagcatgccgatcgccagaaaaataaccagaataggaatgccaagacgggaagaaaatgaactaagtaatatactgctggtgacaaggatggatcctaagatgaaaaggctaattattgttgtggcatccaacggtcggttactcctgattacgctgtctcttatataaaccctaccatattagcggcagagacagcgttttacttagccctgaagcgtgatttttttacattttaagaacaggatgaccgctaatcgtcaactgagtgccttcccgggtgttattcagaatggcatgtgcgcccaacggcagcgtaaccgtgcgttgttcatgaccaaaatcgaggccggtaatgagtggaatcgacaggcgggaacgcaaaaacgcgtacactgactccaggttgtaacctgcgtcataatcattgggcgtgctgccgctaaagctaccgagaataatcgccttctgacgtggcaaaattcccgcatgatagagctgcaacagcatacgttcgacccggaaagggtgctcgttaatatcttccagcaccagaataccgttctcaatttttggcatccacggtgtaccgatcagtgaaatcagcatcgcaagattgcctccccacaacgtgccttcggcccgacatgtcgggccttccccttgccattcaatggtgaaggtttcattgcgtaacgccagccagaaatggtgctcggtaaaggcgttcagttcatccgcgccaaagtttgctaccagcatggggccgctaaaggtgatgacattgccatgcgccagaagaccgcactgaatggcggtaaaatcgctatgtccgcaaatgagcaacgggtcatgttgttggcgagccaccagtgcctgccagtcaatatctgccagtaaacgactggcaccgtaaccgccgcgtacagccagcacgatggtgttgggggtagtcagtctggcaagggaattgagatcttccagacgctctgtttccgtacccgcaaaacgctcacaacgacgggcaataacctcgacgttattgacttgatgccccgcgtcggtaaggcgctggataccacgcagcgcggcgtgctgtttaatgcagtaacccgatggggcaattaagtgaaacagagacatggcaattccttgctgacaacagaaacgaaatgtatatcatgccgcttaggtgtgccgttgtcacctcaacggcgattccaggctataaggatagaagaagtgaaattgagatggtttgcctttttgattgtgttattagcgggttgttcatcaaagcatgactatacgaacccgccgtggaacgcgaaagttccggtgcaacgtgcgatgcagtggatgccaataagccagaaagccggtgcagcctggggcgtcgatccacaattgatcacggcgattatcgctatcgaatcgggtggtaatccgaacgcggtgagtaaatcgaatgccattggtttgatgcagttaaaagcttcaacctccggacgtgatgtttatcgccgtatgggctggagtggtgagccgacgaccagcgagctgaaaaatccagagcgtaatatttcaatgggggcggcttacctgaatattctggaaaccggcccgctggcaggcattgaagatccgaaggtactgcaatatgcgctggtggtgtcatacgctaacggggcaggtgcgctgctacggactttctcgtcagatcggaaaaaggcgatcagcaaaatcaacgatttggatgctgacgagttcctcgaacacgtagcgcgaaatcaccctgcgccgcaggctccgcgctatatctacaaacttgagcaggcactggacgcgatgtaaatcagtcgcgcactttgtccgctttttcccgggcttctcgctcgagagagaaaataatccgctgtaattgccgctccaccgtcgggctgacgttaagaaaacggaagctcagacggggagtggtgatggtttcattcttgccatcaatcactttgcgctcgctgatggagattaactgggcgtcaaagtgaaaaacaccccattgccccatgttgacttcaatctgagcgaagcgcatgccttcttgtaattcggcaggctttgctgtttccagtaatgcgcccatgccgcctaacgacaaatcatacaggcggaaacgtaacgtactgttatccgccagtttggtctggcaaaaataaggcggatggagtggggcggagatgcggaaatatcggcgtcgttgtacaaaccataaggtgggaggcggtacggtaataaatgccggaagctgcaagtattcactctgctgtagttgttcaacagtaaactcgactttcgcaccctgagtttcggcggtaatggtaatgtgctgtgcctttagcacggcgatgttgtcttcggcttgactgccgaaatccagcaccagtttatccggggttattgccagtaatttgctgatcagctgcccgccattccaactgagacgcaaaggaattgcggctttgtgcaaatcgcgtaacacgcccaggacggctaacggattttgtttcaggaactgctcatggtaatgactcacgcggaaaaactcctgactgacaaactgtctttggtttatcggtcacagttaacaaaacttaatacaaatgcgtgaatattttttacatgttgttcttaaatcagccgacatacgcccagcatcgatcccgcccttgcctatacttagagcgttgatgtaagcatttcttgcgtccgattcatcgaaacgagggcctgaacatgggaattattgcctggattatttttgacctgatagccggcattatcgccaagctaatcatgccggggcgtgatggtggtggatttttcctgacctgtattctcgggatagtcggtgcggtggtcggcggctggctggcgaccatgtttggcattggcggctccatcagtggttttaatctgcacagcttcctggtggcggtggtgggagctattctcgttctgggcatattccgcctcctgcgaagagaataagattttcataaggcggatagcgatacagatgccgctatccgctttcacatcagaacgtatactcgacacctgctttacgggtgaaaaaaatcaatatagcacttcgatatccgataaagtcggttcccggtaacaacaacagaatccttttttaattattgtttcgttgtttttggtgtgattcagaaaataaatattttagacagtagccagtcaggcgttaaaaatggggcggatagtgaggcggttttggctgcgcttattgaacatttagaattgatcaatccttctggcagattaagccaaaatacccgttcggcaatgcttcagttacgcgaagaggaatggtctgaattctttttttggttgctaaattctctggagtgtctggattatgtgattattaatttaactccagaaagcaaaaaaacgttgatgagtgaacaccgtaacaatattcaggtagcaattgatgctttatatagccaacgtcggcgtaaatcgccgggtgatgaaagtgaaacacttacccgtagaaatgacgctatcttcggcaaccacgtatggcaaacatttgcgcaatacttcccgccaggacttgaaaaaccgtctgtgtagaaaaaaccatagctatggtgttatctgccgacaacgccatccggagaagccgaatgacgttgtcggagtaagcgctggttaaggtgtgggttgtgcctctttggttgagggttgcgtcgttgctgacttaacggtcggacgcgtcgccggaacattgtcacacggttgctctttcgggcagatcaaatccagcattttcagcgtcacgccattggtccagccaaagccatcctgtaatggatattcgccaccgccgccccccgttccggtggtgctgacatcatatttttccaccagctttttctcccggtcataggtgtgctgaacattggtcaggaagtgccagctaatgtccatcgccacctctttttgcccgtagttttgtaatccttctgtcgcgacccactgtaacggtgcccagccatttggcgcatcccattgttgcccacttttcaccgacgtggtgttcaggccgccgggttgcagcagatgtgttttcgtcgccgtcgccattttgttggcgcgatctttcgctgccgcattgacgtacagcgggaacagggcggccgcggttaactgattgcgcactttatgacttttcaggtcgtaatcggcataccagccttgttgatcgttccacaggtatttttcgatccctttttgacgggcatttgccagcgtttcgtactggtttgccatcgcgttatctccggcagctttgctggcgcgggcgaggattttttccattttaaacatcaggctgttcagatcgaccggtacgatgctggtggtgcgtaaggtatttaactgctgcgggttgtccatccagcgcgagctgaaatcccagccagacgcagcggcagagcgcaggtcgcggtaaatttcagtggcaggtcgattcggattgcttttggcggtggcaatatcttccacccatgactctggtcgtggcgtatcgcgatcgtcccagtagcggttgagaagggtaccatcctgaagtttgacaacgcgtttttcctgttgtccggcttgcaggttttcaacaccgtccatccagtaagcatattctttttgcatttgcggcaggtattgcttcaacgcggcatcgccttcatgctgcgccagtaactctaccatcagggcaaagaagggcggttgcgagcggcttaaatagtaactgcggttgccgttgggaatatgaccgtaagtgtctatttcatgagcaaaattggccaccatatccgcgactttatcccagtgaccgctttcggcaagtcctaacatggtgaagtaactgtcccagtaatatacctcgcgaaagcgtccgcccggcacgacataaggttccggcagcggtaacagagaatcccatttttcggtgttttcggtagaacgcgttaataccggccaaagtccgtcaatatgttcgcgcagtgactgcccctctggcggaacatatttctcgccttctttcggcagggtgaaattgacgttaacgaaatggcgcagatcaaatccgctctggttttgctgcatccgataatcagcaaggatcatcagcggatcgctgttcggcacggcatcggcaaaggttttttggtccggaaaaagtttggcgttttgcacatcattaaacagcggccctaataaaatatcaggcggctgtggtgttaccggtgtttcttctgcctgcaccgatagcgcagcgaaacacaaaaagatacaggctggaattaacgccattttttgcgggcgagaaggtgcgggggatttcatcaatcattctcctttggcgaaaccgaataaaacggtattcaagtatcagaaaaccttagttcaggatcgcactagctgcatgatcgaaatctcattctgcgaactgtcaggcattttagaaaagggaattaaagggataaataacggcgaaatagagtgatcaaataacgtctgtttattagccagccagcggcgttgggttcgtgattagcgaagaaaaatcatcataaattggtgaaaaatataacaggtagttaaaaaccattagtgctgagtaaattgccggatgacatcagaacgatgccatccgaacagtggcttaaccctgacggttgaaacgttgcgttttaacgtccagcgttagcgtttcttctggttgtatcgcatacagtttctcaccctgctggcaaatccagccaatccccagttcacgggcgattagggcgctgtgggataccggacttccggcgctaaggcagataccttttacaaccgccggatccagttgcagtactgtggaaggataaatgttctccgccagtagaatagttggcgagttaaactgcgggagttcttctttcgtttgggtcaggtggaccagggtgcgatgcagaagatcgtccacatcaatatagcgagcttgtagatattcatcatccagttgctggtattgctggctaagttctttaagaacttgctgccaggcatattctgccgtgcaatgttcatgctgaaggagttcgcttgccgccgccagcagttccggatcatctaacagtgtatggtgaccagaaaagattgcggcaatatcgtcaagcccgctggcttctgctttcgctgttaacgtcatcagatctaataacgtgaagtcaatagcctggcgtaatcgatcttgttcttcttccacggtcagggttgattttgcctgtaccgtacataaaactggttgataataaaaggctttacccgaaacaggcggaacgggacgcagagtaggtggagcgacttcctccgtttcaccaaagttatcttcagccagctgacggaaagcgatcagtgcctcttcagcttctggccctttcgcaatcaggcgcagcgtatcgttatagcgaacttgtagtaacgcaatctggttaatactctctggtgtgacgcatttgccgtttttttccagcaacatatcggcattaaatgtcgataaggtataaaccagccgggaggccggacgtacatgcaggccgttacggttttttatgaccaccgccagagaacgggcttcttcatcgtacgcaggacatgtgtcagagatttcagtgtcggaggacggtaaacccagttgttcacgtttggcttccagcgcatgcatggcgtcaaagataactttgtcgatatccgcccccgaggccgcgctgaccgttgctgccagtgtaccttcgaccaacggcgcagcacacaaacgtacttttgcggcgatctcgggagccagcaattccagcgcagtttcagcactcaataatgcgctacccatatccatcatgaccagcacatggtcggcatcagcaacagattcgatggcctccatcactttgacggcatcggtaccaatgggattttgtggatcgtcaattcccgcggcaatggcgattttacaactatcactcattaacatctgacgggctaattcaccgacaccttctcccagtcggctgctatgtgaaactatgaccaggtttaccatcaccaattccttactcttttgcggctaacgccaacatttgcatcataaacatcaccgaggtcgcgccgggatcctggtgaccaatactgcgttcaccgagataactggcgcggcctttgcgggcttgcatcgtaatcgtactttgtgcagcggattcggcgatgctactggcagcttcgagcgccaccggaacagagagattttgctcgctggactgacgtaacgattccaccaccggcacccacacatcacacatggttttatcgccaggttcggctttcccgcgactgattacgccgtccgcgccatcgcggaacatctgataaagctcttccagtgtcaggctttgccgtgcctgggtcgcctgtgcggcgcggataaagaaggtaccgaacagcggaccactggcaccaccgacgctggaaagcagcgtcataccggtattcttgagaatgaaaccgatatctttatctgcgatagcagggagtttttccaccactttgctaaagcctcggttcatatttagcccgtggtcagcatcgccaatttcgcgatccagtccggtaagatactcgctctcggtgctgaaaatatcgccacaacgagtgagccagttaacaatttgagttctgctcagtgacattgctttctccttatttaccccagttaagggccggggtgtggaccggggcgtcccagagtgccagcgtttcgtcatcaactttcagtaaggtgattgagaaaccggtcatatccagtgaggtgcagtacgcgccaattaaattacgttcgatagtcaatcccgcttgctggcaacgtgtggtcaggcggttatagacgccgtacagctcagaaagcggagttgcgccaagattgttaaccagcgcaatcacccgatcgccagactggagcggttgtttggtttgttgttcttcctgccaactgccttgttgataatcccagaaacgcaaagtgcgatggtatgagccatttaccagcagggtgtcgaacatttcatcgacggtttgatcaagggaagagaaggggcggcggtcaatacccggctcaccatgaatgccgacgccaaactccatctcattatccgccagggtaaaagaaggtttgcccgcggcaggaacggtacaggcaccgagagcgatacctattgagtggccttgattattcagcttacgccccagttccgcacaggcgtccagtgagtcgccacgctccgccgctgcgcctacgagtttttcaattaatacggtgttggcaacgccgcgtcgcccggcagtataaagactgtcttttaccgcaacgtcgtcatcaatgaccacagtggtcacttttacgccgctatcgtgcagtaactcggtcgctgtttcaaagttaagaatatcgccggtgtaatttttgataatcaacagtacaccttcgccgccatcaacttgcatggcgcattcaaagattttatcgggcgtcggtgaggtgaaaatttcgcccggacaggcccccgaaagcatcccctgaccgatataaccacagtgcatcggctcgtgtccgctgccgccacccgacagcagggcgacttttcctgcaacaggggcatcagctcgggtgacatacaccggatcctgatgcagtgtcagcgatggatgcgctttcgccagtcctgccagttgttcgtccagtacgtcttgcacatcattgatcaattttttcattattttgctccagcaattacggtagggcatggatgatgttcaacgacacggcgaccactgactgccgatgaatccattgtgcatcaggcaagggaaaagaaaattagcccaaattatgtttcatagtgaaacatatgctttaatgaatgttccatattgaaacttttacgtgtattaatacttaaaattgcgagccggaacaccttttgtcataagggatgcgggatatgagtggcgcttttaacaacgatggtcggggcatatctcccttaattgcaacctcctgggagcgatgcaataagctgatgaaacgggagacatggaacgtaccacatcaggcccagggcgtgacatttgcttctatttatcggcgtaagaaagcgatgctgacgctcgggcaggctgcgctggaagatgcctgggaatatatggcaccgcgagagtgtgcgctgtttatcctcgatgaaaccgcctgcattctcagccgtaatggcgatccgcaaaccttgcagcagctaagtgcactgggattcaatgacggcacgtattgcgccgagggaattattggtacttgtgcgctatcgttagcggctatctctggtcaggccgtgaaaacgatggccgatcaacatttcaaacaggtactctggaactgggccttttgtgcaacgccgttgtttgacagcaagggccgattgacgggaacaatagcgctggcgtgtccggttgagcaaactaccgcagctgatttgccgttgacgttggcaatcgcccgcgaggtcggaaatttactgctgacggacagtttgctcgctgaaactaaccgtcatttaaatcaacttaatgccctgttagaaagtatggatgatggcgtgattagctgggacgagcagggtaatttgcaatttattaatgcccaggcggcgcgggtcttgcgccttgacgcgacggcaagtcagggacgggcaatcactgaactcttaacgttacccgccgtattgcaacaagcaataaaacaggcacatccgctcaaacacgtagaagcaacctttgaaagccagcaccagtttattgatgcggtgataacccttaaaccgataatagaaacgcagggaaccagctttattttgttgctccatcctgtggaacagatgcggcagttgatgaccagtcaattaggaaaagtcagccataccttcgctcatatgccacaggacgatccgcaaacccgccgcttgattcattttggtcgccaggcggcgcgcagtagctttcctgtcctgctttgtggagaagagggcgtgggcaaggcactgctaagtcaggcaattcataatgaaagcgagcgtgctgcaggtccttatatcgccgtcaattgtgagttatatggtgatgctgcgctggcggaagaatttattggtggcgatcgcacggacaatgaaaatggccgtctgagtcggctggaactggcacacggcggcacgctgtttcttgaaaagattgaatatctggcggtggagttacagtctgctttgcttcaggttatcaagcagggggttatcacgcgactggatgcgcggcgtttaataccaattgatgtcaaagtgattgcaacaacgaccgcggacctcgcaatgctggtggaacaaaatcgttttagtcgccagctgtattacgcgctgcatgcatttgaaattaccatcccgcctctgcgtatgcggcgtggcagcattccggcgctggtgaataacaaattacgcagtcttgaaaaacgcttctctacgcggctgaaaattgatgacgatgccctcgctcgcctggtttcttgtgcatggccaggcaacgattttgaactttacagcgtcatcgagaatcttgctctgagtagtgataacgggcgcattcgcgtcagtgatttgccggaacatctgtttaccgagcaggcgacagatgatgtcagcgccacccgcctttccaccagtctgtcatttgcggaagttgaaaaagaggcaattattaacgcagcccaggtcacaggcggtcgcattcaggaaatgtcggctttacttgggatcggccgcactacgctgtggcggaaaatgaagcaacatggcattgatgcagggcagtttaagcgccgggtatgaaagacagaaacgatttctgatacatcagagtgatctgtatttcattccggcgcacgctaacaattttcagcatcgtttaagggcttgtctatcccgcacttaaaagctgaagcgatatcctccgttgacttgcttctgatcaaagaggttaccctgcgtgtaatccgcttcgagatagaatgtgtgctgtttgttatactgtgcactgactcccacgccgttattccagccattacctttgaaactgtacttctcccgggagttgttcaacagatattcggtatcccctgaaaactcgcggatagcgccagtcttcacatagacattcagctggctgttgcctgcggtgatgtcataccccagtatcatgctggcacgccccagcagcgattcgtagtgattcagatgtatattgaggccattactcgccttcatagtcatctcattctggtggctgtatgtaagctgggtttgcggctctatatagaacccataaccagtaggggacaggttgaacctctgcccggcttccagggagatgctcattccattcgcagtgccgttggcgttaacgccgttgttctgactgtccagtacgtggaaactatttttctggcgcgatgcttttataacgagatcgctgtaaaaaccgttttgtgccatgtaactggcgtacattcccatgtagtctgaacgtgcggtaccgtcgcctccgctatagtccggcgatgcatgtgttgagccaatatacagaccgacatacaacggcattacatcagagagacgtttatccccaccaaactggataccgctgtaacccatgtcaaagccgctcagtttgccactggcaaaggagtccaggcttcccccataactgcgcaaccagatattaccgtctttactctgatttcgcaggtcacccatccgttgcatcagcgtacggttttcaacatagttcaataagtaaccgacattgagataattgccgccagcatctgcggtcgtggtgggtttaggcgtgggagcgggttcaggcgtaggatcggggttgactatgggaggctgagcgggagctggtgtgggttcaggattaggagtcggttccggaactgtcccggaagcgtaaagctcccagttagtgccatttttacgcacatcgtacagatatccccccaactcaacctgagaagacgcgctgaacgaggccgcgccgtcagtggtttttaccactgtcagaacttcatttcccgttgtggcctcgctgccctggttgcggatagccaatacgtgattaccagcactactcccgctgatattcaataaatcccctttattattaacgccattaccctcgccaacaacatcagcacgcataataaaggtactgttaccgctcaggttctctacgtttaatgtggcaaatgtgccggcagttgacccgtggctggcaaaatcgacagttgaatggctcagcgccagcgtgtcgagattagaattacttgttacgttccagacgctgttattcattgcaacgtccagttttccgccattgacattatcgctgagggaggaacctgtccaaaccgacccagggtgcatatccagattgattagcccacctttggaaagaacgctaccgttgataagcatacgacccgaggcgttgatgcggctggcggcataaccatcgtcatgttgcgttgcgatggccatctggtcgggtgtactcatatcaatgaccagatcgctcgtgaggtcgatctggctgttggtcatggcataaattcccctggctcctgccgcgccggtgatagccaaactgtctccggttattctaccgccgctgagagcccacaaacccagcgccagactgccattacgatcaactgtaatatcggtattttgcatgttgacaacagccgttgccgtctgggccgaggcaccataagaaccgccggaaaagatgctgtttcgttgcgctgccgtgccagtaaaattgattatcgcgtctgaaccactggtgacgaggccaccgccctgcgcggaagaaatatggctatctgcaccgatagtggttgtaccaccacgaacttcgacgccattggccgcggctccagttacatcaacagtgagtgcattcgcgctaacctggccaaagctccagaggccgtgagcattatcgccattggttttaatggtactgtttgttccgagatcgacaacagagtttttctgtacgtttatccccatggcgctgtagccctgaacatcgattgtcaggtctgtagccgtaaaacgcgcagcaccattggcgttattgccgttgagaccaccgatataaacacctgtacttccatcggtcgtgattttacttccgcttccaagatcgacactggtgccatagtcattgatggttaggcctataccgttcgagttttcaatggtgaattgagtggctgttagtgttgagctatgcccaataatgatgccgtcatcgttactcttaatggtgctgcctgtgcctaagtcagcatgggtatagtcaccaattaagttaatgccgatggcagaggtttgaccaacaacatctactgtgagtcggttagctgtcagggagctgtttttgccctgaataatgattccttttgcatatccagaggcgtcgttgacattgacggtgacatcattacccaggttgatattgccaggcgtgtttcctgctggggtcattacaccatagaggtttcctgatggatcggcggtatctcctgtaattctgtcaccatcattaatagtaatattggtgccatattgacttcctgtatcagcagctatcagcaggggggaaaagataattgcattcaaaccaatagcgccaaattttatcagttgaattgagggcgaacggatttttaattcagcgagacgatctgctttggtattcccattgtgttgtttgatgcccataccactcctatatagtacccagactatgggtctatggattttgtcattttgtttaaatcaatgaataatatcctcttatcatcatgatatttgtatggtgcaatcatgatgagcttctcagagaataattctctattaccgggcaaaatcaggaacacaggaattaatatatatttaacatcccccttacaaaggtgagtttatatcgagttattccctaagttgtcgttacttattccaattcgttactataaatatggcaaaaatattacaacaaacagcggttaaaaaatttggtgaagattttttgtaataatcctaattagttatgggaatttcgcttgatgtatctgcataacaaaaacaatatgcgccatttttgcattactaataagaaaaagcaaaaaacatcgatattcatttttggtcaatgggttttctggcctatcgttgttattgtgctactggttatcattttcatcttgccagcatattggagcgtgatcaattttgatcagctgtgaagggggctgatgtgtagtgatacaaaaacttacgttatatcactgctaatgagatatccggcatctgaacacttatgtctttaattattctcgtggttcactataggcaataagcacaaaagtgtaggatgttacaagaatgattaggactcggtgaaatgaaaaatccacgcaattgcgtggattttatatacttttgcgctcttcatgagatttagcgaaacctcatgagacaataaattaattagacgttgaaaaggaagttcatcacatcgccatctttcacgatgtaatctttaccttctgcacgcattttgcctgcttctttcgcgccttgttcacctttgtaagtgatgaaatcttcaaacgagatggtttgtgcacggataaagcctttttcaaaatcagtatggattttgcccgctgcctgcggcgcggttgctccaaccggaatggtccatgcacgcacttctttcaccccagcggtgaagtaagtttgcaggttcagcagtttataaccggcacggatcacacggttcaggcccggctcttccagcccaagctcctgcataaactcgtcacgttcttcgtcgtccagttcggcaatgtctgcttcaacagcagcacaaaccggaaccacaacagaaccttctttcgccgcgatttcacgcacctggtcaagatatgggttgttttcaaaaccgtcttcgttgacgttggcgatgtacattgttggtttcagcgtcaggaagctcaggtaacgaatagccgctttctcttcagcgcttaaatccagcgcgcgcagcatacctgcattttccaactggggcaggcatttttccaggaccgccagctcagctttcgcgtctttatcgccacctttggctttcttctgtacgcgatgaatcgcacgttcgcaggtgtcgaggtctgccagcgccagttcggtgttgataacttcaatatcgtcagccgggttaactttgccggaaacgtgaatgatgttgtcattttcaaagcagcgaacaacgtgaccgatcgcttcggtttcacggatgttggtcaggaactggttacccagaccttcgcctttcgatgcgccttttaccagaccggcgatatcgacaaattccatggtcgtgggaagcgtacgctgcggttttacgatttcagccagttgatccaggcgaggatcaggcattggtacgacgcctgtgttcggctcaatggtgcagaatggaaagttggccgcttcaataccggctttggtcagcgcgttgaacagggtagatttcccgacgttgggcaaaccgacgataccgcatttgaatcccatgatttaaatcaccttaatatcttaataatcaacctgttattgctaacagattgcagaaatggaaataactttgcctattatacacggcactcggcaaaaatgccgcagacaacgacttattgcgctttaaaggcgtgcaatcggttcgttgctttggtcaagccatctgtaaaccacatttcagtacaacgcgccgcttcgtcaatggcttcatcaattaacttctgttcactaacaggcggtttgcctaacacaaaaccgacaactttatttttatcgcccggatgaccgattccgatgcgtaaacggtgaaagttagggttattacccaatttactgatgatgtctttcagtccattgtgaccaccatggccaccgcccaatttaaatttggcgacgccaggaggcagatccagttcgtcgtgggccaccagaatttcgtccggattaatgcggaaaaaactggccatcgccgcaacggctttgccgctgagattcataaatgtagtcgggactaacaggcggacatcttcgcctccaagagtgactcgcgaagtataaccaaagaatttagcctcttcgcgcagcggagcgcgcaaacgctctgccagtaagtcaacgaaccaggcaccagcattatgtcgcgttgcggcgtattcagcaccggggttcgccaggccgacaatcaatttaatcgtcacgtttttttgtcctgagtgtgtacataactggcgcgtagtttactggttgcggccccgcttgacaaaaaactgcgtatcaaatgcagataacgtaataattgcctgagtggactattagaaagtcaaggtgttcaggcgtttatttgtaaagttttgttgaaataagggttgtaattgtgatcacgcccgcacataacccactgggtgttgtctatactttacacataaggaagaggggtattccctgttacaacccagaaagttccggaggtgacatatgaaacgcaaaaacgcttcgttactcggtaacgtgctcatggggttgggtctggtggtaatggtggtcggcgtggggtattcaatcctcaaccagttaccacagtttaatatgccccagtatttcgcacatggtgcagtgctaagtattttcgtcggtgccattctctggctggcgggtgcccgtgttggcgggcatgaacaggtgtgcgaccgttactggtgggttcgccactatgacaaacgttgccgccgtagcgataatcgccgtcatagctaacaaataatgcagtttgctgaccagtcagtttgcgctgactggtcaatctcgtacttataaatccgccatcgccgcgcgacgattcgggaagaacgccaggcgtcccgggatcggttgaatgccagcgcgagccatagtgcgcagtggctggaattccacgttgcacacgcgcagttcacatccctcgggcagacgcttcacaaaacgctggaacgcatcaagaccaccagcatcaagtaccggaacggcatcccacttcagaatcacaatccgtttgccttcaagacgtgactccaggtccgtgaataagccttcagcagcagcaaaaaacagcgggccaataacgcgcagaaccaggacatcgtctggaacatctacgactaccggtgccaggcgagtcatacgtgcgatacgacgcataaacagcagcgatgccagcacgatccccacgctgatggcaataaccatatcaaacaacacggtcagcgacatgcacagcagcatgacgatgatgtcatctttcggcgcatgacgcagcaagtcgaccactttgtgcgcttcactcatgttccacgccaccatcaacagcagggctgccatggcggaaagcggcagccaggagagcagcggtgccagtaccagcagggcaagaataaccagaatagagtggatcaccgccgagataggggacgttgccccggcacggacgttagcggcagaacgcgcgatggcagctgtagcggtaataccaccaaagaacggagcgataatattccccagtccctgtccaaccagttcgctgttcgccttgtgtttcgtcccggtcataccatccagcaccacggcgcagagcagagattcgattgcgccgagcattgccattgagaatgccgcaggcagcagtgtgcgaatagaatcccaggttagcgtgaattctgaattaggcagatcccacggcagcaccagttgcggcagcagttgcggaataccgttaccctgagaaccatcggccaggacgtagtggaattgcgaaccgatggtagcaacatgtccgccgagcaggttaacaatccccatcaccgcgcaaccagccagcaaggccggaaggtgaccgggtaaacgaatgcccagacgcggccaaaaaacaagaatacctagcgtcacaatgccaatggcagcatcacccacattaatggtcggcagcgccataaataatgcgccgactttttgtagataatgttccgggacatgggccatttgcagaccgagaaaatctttaatctgcatggtaccgatggtgatcccgatacccgaggtgaaacctaaggtgacggaaaccggaatatactcaatcaggcgaccaaagcgtgccagacccatcagaatcaaaaagatccccgacagcaaggtcgcaaccagcagtcctgccagtccaaactgttgcgacacgggatagagaattaccacaaatgccgcagtcggaccggaaacgctaaagcgtgacccacccgtcagagcaatgacaatccccgcaacagctgcggtatataaaccgtactggggtgccacaccactaccaatagccaacgccatcgccagcgggatagcaataatcccgacggttatcccggcaatcaggtcacgggtaaaccgtgcggcagtatatttttctttccagcaagcgtcgatcagagcgcggaaaggcatcacatgtgaggaaaatattttgttcacaataatgtttcatccgtgagcgcatcatctgtcaactaaatggcaggtgaaggaggcataggtcatacaaatggatattacagacaaaaaaacccgccgcagcgggtctttgagccgggttcgattagtgttcgaacatggcagagatcgattcttcgttgctgatacgacgaatcgcttcggccagcatacctgacagggtcagagtacgcacgttcggcagtgatttgatttcatcgctcagcggaatggtatcgcagacaacgacttcatcaattacagagttacgcaggttgttcgccgcgttgccagagaagatcgggtgagtcgcgtacgcaaatacacgtttagcaccacgttctttcagagcttcagcagctttacacagcgtaccgccagtgtcgatcatatcatcgaccagtacgcagtcacgacctgcaacgtcaccgatgatatgcatcacctgtgaaacgttcgcacgcggacgacgtttgtcgatgattgccatatcggtatcgttcagcagcttagcgatagcgcgggcacgcacaacgccgccgatgtccggagaaaccacaattgggttatccagattcagctgcagcatgtcttccagcaggatcgggctaccaaatacgttatcaaccggaacgtcgaagaaaccctgaatctgttcagcgtgcagatccactgtcagcacacggtcaacaccgacgctggagaggaagtctgcaaccactttcgcagtgattggtacacgagcggaacggacgcgacggtcctggcgcgcatagccaaagtaggggataacagcggtgatacgacctgcggaagcacgacgcagggcatcaaccataacgactaattccatcaggttgtcgttagtaggggcacaagtggactggatgatgaaaatatcaccaccgcgtacattttcattaatttgtacgctgacttcgccatcgctaaagcgacctacagcggcgtcgccgagtgaagtgtacaggcggttggcaatacgttgtgctagttccggggtggcgttaccagcaaaaagcttcatatcaggcacgagaagaacctcaggcatgcgtccattggtggaaagaatctgccgaaaactgtgcgggccaggcatgatcctttccaggcggtgtattaaagagcgcgatgcaacgtctggaacaaggtgacgttgtcaccgaaactcagcttgcccggcttaaagcatggctctgtgcaatggggaaagattagcgcctttcgccacaaagccattgagccattccggggcttgctctagcacctggcgggcttcagactctgtatcaaattcagcaaagacacaggcccctgtcccagtcaggcgcgacggggcgtattctaacagccaggaaagcaccgcatcaacctcgcgaaaacgttttcttgcgataacctcgcaatcattgctgaattcacattttagcaacgtttctattgacctttttggcgtattgcgcgggagttcaggatctttaaaaatcaccggagtcggaatacttacaccagggtgcgccaccagataccacttctctggcggatccaccggcgttagtatttcaccaacgccttcggcaaacgcggcatgcccccgaacaaagacaggaacatctgcgcccagcgtcagccccatttccgccagctcatccatgcttagcccgcattgccagagatgatttaatgccaccaggaccgtcgcggcattggatgaaccaccgccgagaccgccgcccatcggcaaacgcttgtcaatgctgatattcgcaccgcttcccgtcggaagacgcccgctgtctgccgcagttttcatcaacaatcgcgctgcgcgaacgatcaggttatcttcatgttccacgccttcaacgggcgttaacagacgaatatccccatcgtcacgaagctcaatgctgatggtgtcgccgtaatcaagaaactgaaacagcgtttgcagcgtgtggtaaccatccgcacgctgaccggtaatgtataaaaacagattaagttttgccggagagggccactgtgtccgcattatttcactatccagttatccatttttaacttgatgcgttgaccaccgtcggtgagttccatattggctggcatcgcaggttgcgttttggtgtcataaccaccataaacaaccttccagtttttgccattctggctgtaggtaatttcgctcaggcggtactggtcgtccagtttgtagtcggttgcatcacccggtaaacctaaaatccactggcgcaagctgttgagcggaattggcattccggtcaatttgccaatcatctcttcggcgtcatcggcggtataacgctgacctttattgtcgactaactgcacgttacccggttgagcattcagctccagttccgtgctgcccaatgggttagtgagcagcagacggtagcgatcctggccggtttgctgccagaaaaagcgggcgtacactttttgttggtcagaaatataagcgaacgcgccgcgagtctgatactgattaagattgcgcacgtcttgctgatgctgacgccattgtggcgaatccgggcttttgccaggacctttgggcgtggtaacggaacaggcagtgagcacaagagcagccagcggtagcaggcggataagacgaaaatcgggcaggggcatagtgatgacaagtccttgagatacgttgcagttataacccttaatgctagcgttaccgtccgctatcgtctatgttcaagttgtcttaattgccagaatctaacggctttcggcaattactccaaaagggggcgctctcttttattgatcttacgcatcctgtatgatgcaagcagactaaccctatcaacgttggtattatttcccgcagacatgacccttttagcactcggtatcaaccataaaacggcacctgtatcgctgcgagaacgtgtatcgttttcgccggataagctcgatcaggcgcttgacagcctgcttgcgcagccgatggtgcagggcggcgtggtgctgtcgacgtgcaaccgcacggaactttatcttagcgttgaagagcaggacaacctgcaagaggcgttaatccgctggctttgcgattatcacaatcttaatgaagaagatctgcgtaaaagcctctactggcatcaggataacgacgcggttagccatttaatgcgtgttgccagcggcctggattcactggttctgggggagccgcagatcctcggtcaggttaaaaaagcgtttgccgattcgcaaaaaggtcatatgaaggccagcgaactggaacgcatgttccagaaatctttctctgtcgcgaaacgcgttcgcactgaaacagatatcggtgccagcgctgtgtctgtcgcttttgcggcttgtacgctggcgcggcagatctttgaatcgctctctacggtcacagtgttgctggtaggcgcgggcgaaactatcgagctggtggcgcgtcatctgcgcgaacacaaagtacagaagatgattatcgccaaccgcactcgcgaacgtgcccaaattctggcagatgaagtcggcgcggaagtgattgccctgagtgatatcgacgaacgtctgcgcgaagccgatatcatcatcagttccaccgccagcccgttaccgattatcgggaaaggcatggtggagcgcgcattaaaaagccgtcgcaaccaaccaatgctgttggtggatattgccgttccgcgcgatgttgagccggaagttggcaaactggcgaatgcttatctttatagcgttgatgatctgcaaagcatcatttcgcacaacctggcgcagcgtaaagccgcagcggttgaggcggaaactattgtcgctcaggaaaccagcgaatttatggcgtggctgcgagcacaaagcgccagcgaaaccattcgcgagtatcgcagccaggcagagcaagttcgcgatgagttaaccgccaaagcgttagcggcccttgagcagggcggcgacgcgcaagccattatgcaggatctggcatggaaactgactaaccgcttgatccatgcgccaacgaaatcacttcaacaggccgcccgtgacggggataacgaacgcctgaatattctgcgcgacagcctcgggctggagtagcagtacatcattttctttttttacagggtgcatttacgcctatgaagccttctatcgttgccaaactggaagccctgcatgaacgccatgaagaagttcaggcgttgctgggtgacgcgcaaactatcgccgaccaggaacgttttcgcgcattatcacgcgaatatgcgcagttaagtgatgtttcgcgctgttttaccgactggcaacaggttcaggaagatatcgaaaccgcacagatgatgctcgatgatcctgaaatgcgtgagatggcgcaggatgaactgcgcgaagctaaagaaaaaagcgagcaactggaacagcaattacaggttctgttactgccaaaagatcctgatgacgaacgtaacgccttcctcgaagtccgagccggaaccggcggcgacgaagcggcgctgttcgcgggcgatctgttccgtatgtacagccgttatgccgaagcccgccgctggcgggtagaaatcatgagcgccagcgagggtgaacatggtggttataaagagatcatcgccaaaattagcggtgatggtgtgtatggtcgtctgaaatttgaatccggcggtcatcgcgtgcaacgtgttcctgctacggaatcgcagggtcgtattcatacttctgcttgtaccgttgcggtaatgccagaactgcctgacgcagaactgccggacatcaacccagcagatttacgcattgatactttccgctcgtcaggggcgggtggtcagcacgttaacaccaccgattcggcaattcgtattactcacttgccgaccgggattgttgttgaatgtcaggacgaacgttcacaacataaaaacaaagctaaagcactttctgttctcggtgctcgcatccacgctgctgaaatggcaaaacgccaacaggccgaagcgtctacccgtcgtaacctgctggggagtggcgatcgcagcgaccgtaaccgtacttacaacttcccgcaggggcgcgttaccgatcaccgcatcaacctgacgctctaccgcctggatgaagtgatggaaggtaagctggatatgctgattgaaccgattatccaggaacatcaggccgaccaactggcggcgttgtccgagcaggaataatggaatatcaacactggttacgtgaagcaataagccaacttcaggcgagcgaaagcccgcggcgtgatgctgaaatcctgctggagcatgttaccggcagagggcgtacttttattctcgcctttggtgaaacgcagctgactgacgaacaatgtcagcaacttgatgcgctactgacacgtcgtcgcgatggtgaacccattgctcatttaaccggggtgcgagaattctggtcgttgccgttatttgtttcgccagcgaccttaattccgcgcccggatacggagtgtctggtggagcaggcactggcgcggttgcctgaacaaccttgccgtattctcgatctcgggacgggtaccggggcgattgcgcttgcgctggctagcgagcgcccggactgcgaaattatcgctgtagatcgtatgcctgatgctgtctccctggcacaacgtaatgcccagcatctggcgatcaaaaatatccacattctgcaaagcgactggtttagcgcgctagccgggcagcagtttgcgatgattgtcagcaatccgccgtatattgacgagcaggaccctcatcttcaacaaggcgatgtccgctttgagccgctcactgcgctggttgcggcagacagtggaatggcagacatcgtgcatatcatcgaacagtcgcgtaacgcgctggtatccggcggctttctgcttctggaacatggctggcagcagggcgaagcggtgcgacaagcatttatcctcgcggggtatcatgacgtcgaaacctgccgtgactatggtgataacgagcgcgtaacgctcggccgctattatcaatgacaagtttttctacactgcttagtgttcatcttattagtatcgcgctttctgttgggctattaaccttacgtttctggctacgttatcagaagcatccacaggcatttgctcgctggacgcgcattgtgccgccggttgtcgatacgctgttactgttaagcggcattgcgttgatggctaaagcgcacatcctgccattttccgggcaggcacagtggctgactgaaaagctgtttggagttatcatttatatcgttttgggttttattgcactcgattatcgtcgtatgcacagtcagcaggcgcgcattattgccttcccgctggcgttggtggtgctgtacatcatcattaaactcgccaccacaaaagtaccgttactggggtaagtcatgagatcgttagctgatttcgaatttaataaagcgccattgtgcgaaggcatgatcctggcttgcgaagcaatccgccgcgattttccctcgcaagatgtttacgacgaactggagcgtctcgttagtctggcgaaggaagaaatcagccagcttctgcctttagaagagcagttggaaaaactgatcgcgctgttttacggcgactggggatttaaagcctcacgcggtgtttatcgtctttccgatgcattatggctggaccaggtgttaaagaatcgacagggcagtgcggtatcattaggtgcggttttattatgggtcgcgaatcgtctcgatttgccgctgctgccggtgattttccctacgcagctgatattgcgcattgaatgtccggatggcgaaatttggctgattaatccttttaacggtgaatcgttaagcgaacatatgctggacgtatggttaaagggaaatatcagcccgtcggcggaactgttttatgaagaccttgatgaagctgataacattgaggtaatccgcaaattgctggatacactcaaagcctcgttgatggaagaaaatcagatggagctggcgttacgcaccagcgaagctttattacaattcaaccctgaagatccctatgaaattcgcgatcgcgggttgatttatgcgcaactggattgcgaacacgttgcgttgaacgatttaagttatttcgttgaacagtgtccggaagacccgatcagcgaaatgatccgtgcgcaaataaataacatcgcgcataaacatattgtgctgcattaattaatcgacattttactcaagattaaggcgatcctatgaaacaaaaagtggttagcattggcgacatcaacgtagcaaatgacctgccgttcgtactgtttggcggtatgaacgtgttggaatctcgcgatctggcgatgcgcatttgcgagcactacgtaactgtgacccagaaactgggtatcccttacgtgttcaaagcctcttttgacaaagccaaccgctcctccatccactcttatcgtggaccgggcctggaagaagggatgaaaatcttccaggagttgaagcagacttttggcgtgaaaattatcaccgacgttcacgaaccaagtcaggcacagcccgttgctgatgtcgtggatgtgattcagttgccggcgtttcttgctcgccagactgacctggttgaagccatggcgaaaaccggtgcggtaattaacgtcaagaaaccacagtttgtcagcccgggacagatgggtaatatcgttgataaattcaaagaaggcggcaacgaaaaagtgattctttgcgatcgcggtgctaacttcggctatgacaacctggttgtcgatatgctgggcttcagcattatgaagaaagtgtctggtaactcgccggtgattttcgacgtgacccacgcactgcaatgccgcgatccgtttggcgcagcttccggtggtcgtcgtgctcaggtggctgagctggcacgagccggtatggcggtaggtctggcggggctgtttattgaagcgcatccggatccggaacatgcgaaatgtgatggtccatccgcgctgccgctggctaaactggaaccgttcctcaagcagatgaaagcgattgatgatctggtgaaaggtttcgaagaactggataccagcaagtaatcttttttgcttgaaaaataaagtattagcgttctgcgttaagacttttttcatgggtgccggatacaaaaaaggccgcaggctgttacccctgcggccggtttcgggcgcatattgccatcacggcagcctgacgcccgttttcaccttacttccggttacgccaccagctgacaatcgctgcggtaataattcccgccaggatcggtgctgccaggtcgtgccagaaaatcatggcaaactgcgcgagcgtcatatagccgccttgttgtaatgacaacattttgcggctattcttgaattgttctggttcaagattagcccccgttctgttgtcaggttgtacctctcaacgtgcgggggttttctctttccagcaaccaatgccaccagggataaagcccccgcaacattgcgcctcaccggataacgccggcttggtgtggatactacgactcaattcatcttcacttcatccctgaaatgtttgcaatgaagagtgcattccggtttttcaacagctgttacagtcatttcatgagtgctctggatgaggcttccagctcgggttgccaatatttacttgtggaagtgataaagacaaaaatggccgcaggctgttacccctgcggccggtttcgggcgcatattgccatcacggcagcctgacgcccgttttcaccttacttccggttacgccaccagccgacaatcgctgcggtaataattcccgccaggatcggtgccgccaggtcgtgccagaaagtcatggcaaactgcgcgagcgtcatatagccgccttgttgtaatgacaacattttgcggctattcttgaagtgtctggtttcaagattagcccccgttctgttgtcaggttttacctctcaacgtgcgggggttttctctttccagcaaccaatgccaccagggataaagcccccgcaacattgcgcctcaccggataattccggcttggtgtggatactacgtctcaattcatcttcacttcatccctgaaatgtttgcaataaagagtacattccggcttttcaacagctgttgcagtcgtttcatgagtgctctggatgatgcttccagctcgggttgccaatatttacttgtggaagagataaagacaaaaatggccgcaggctgttacccctgcggccggtttcgggcgcatattgccatcacggcagcctgacgcccgttttcaccttacttccggttacgccaccagctgacaatcgctgcggtaataattcccgccaggatcggtgctgccaggtcgtgccagaaaatcatggcaaactgcgcgagcgtcatatagccgccttgttgtaatgacaacattttgcggctattcttgaagtgtctggtttcaagattagcccccgttttgttgtcaggttttacctctcaacgtgcgggggttttctctttccagcaaccaatgccaccagggataaagccccgcaacattgcgcctcaccggataacgccggcttggtgtggatactacgtcgcaattcatcttcacttcatccctgaaatgtttgcaatgaagagtacattccggcttttcaacagctgttgcagtggtttcgtgcagggtgtggtacaggctcgcaattctgattaacgacctgtccaggtagtatgaagaaatacaataagcaggaatttatattatctcccccgattaccgtcatcggaggagatataactgtcaggcaaatatcgtcatcaaataggcggcaaacagtgccagatgcgctgcgccattgagcacgttagtacgtccggtggagaaggagatatggcacagcactaaagaggccaccatcaccaccatttctggcgcaccaagtgcaaactgcaattcgttacccgtcataaaggcaattagcgtgacgacaggtacggtaagcgaaatggttgctaacactgaaccaaagaacagattcatcgcgcgctgaacctggttgttcaacactgcttttaatgcacctaaaccttccggcgacagaatcaacagtgccaccaggaagccagtaaaggcgacaggggcattcatgctgtcgagcaatgtctccagcgagctggcgttcattttggtcaccgcaataacggcaatcagatggataatcaaccagatagcatgccacaggctgctatgggcagacggtttaccgtgatgcgggtcgtcatcatcactgtcatcttcgtgctcgtagacaaacaaactttgatgcgttttggtctggatcagcaaaaatacgccatacattgccgcagaaattaatgctaccagtaacgcctgaccggttgaaaaattcgccgcaggcagagccattggaaataccagtacgattatcgccagggggaacagcgcaattaaatactgcttgataccaaacagattcatatattgggtggcaaacttacgaccgcccaacaataatgaaaagccaaccagcccaccggtaacaatcataatgattgaatagagcgtatcacgcattagcgttggcgcggcgtcgccggttgccattaaagctgaaatcaaactgacttcaagaataaccactgaaaggctaagaataagcgaaccgtaaggttctcccaggcgatgggctaatacgtccgcatgacggacaacactaaaggcgctacttaaaataccaataagcgcaagaagattgatggcaatgaccactggtagtgtctggctgcttccccacaggaacagcactaccagcgccagaaccgggaaaataagcgaagtctccttgtggcgggtttttaccgcctcttgagcatttgacattatggttatccctttgcagatgaatttatcgaaaatgtaaaaaataggtaggaaaaataacagaaagtgtctggatatcggtaacattttacgaatttttaccccgctgtcgattttttactcattggggcataaaaataagtattacgtttagacaatgtttgttttagcgtctcttaagaagagtctgacctgaaaattcttatgttttggcaagagtagatattgttgaccacacttaatgttcaactttgtaaaaggagtcaacgatgccgtataaaacgaaaagcgatctgccggaaagcgtaaagcacgttctaccgtctcatgcccaggatatctataaagaagcgttcaacagcgcatgggatcaatataaagataaagaagatcggcgtgatgacgccagtcgcgaagaaaccgcgcataaagtggcctgggctgctgtgaagcatgaatatgccaaaggggatgatgataaatggcataaaaaatcgtaaaaccggtcgcttagttaaagctattcgtgcggtgttgccttgcaagtggtccgtggattgcatattgtcccgttagtggtttcaaaatgagcagtaaaaatgtccggaagacaccaaaaagttgtcgcagggaagtatgcagtggcggaagtgtaaggtgataacgcgtgatttcttgatgaatgccgattgtaaaacggcatttggtgccattgaagaatcactcttatggtcagcagaacaacgggcggcttcgctggcggcgacgctggcttgtcgacctgatgagggaccggtgtggatcttcggctatggatcgttgatgtggaatccggcactggagtttaccgaatcgtgcaccggtacactggttggatggcatcgcgcattttgcctgcgcctgaccgccgggcgcgggactgcgcaccagccgggacggatgcttgcactgaaagagggcggacgcaccacaggcgtcgcctatcgactgccagaagagacgctggagcaggaactaaccctgttgtggaagcgagagatgattaccggctgttatctgccaacctggtgtcagcttgatcttgatgatggacgcacagtaaacgccattgtgtttattatggacccgcgacatccagaatatgaatctgatactcgcgctcaggtcatcgcgccgttgattgcggcggcgagcggtccgctgggaaccaacgcacaatacctgttttcactggaacaggagcttatcaaactgggaatgcaggacgatgggctgaatgatttgctggtatcggtaaaaaaactgctggcggagaattttccggatggtgtgttacgtccgggattcgcctgagtaaacttcccgcatagtggggcgtcagacgccccctcaaacattaaaatgtgagcactttatcggctgacagcgtccattgcgccagttccacaagagtaccgatttccaccccatcaatcagaggaagtgtactaatcccgcgcccgtcggtacaggttttgcacaatttcaccggtacattctgagcggtaaggatctccagcatttgctgaatgttgtagccttcccctggtttttgcccgcgcaacccggctgtgaccgcatcagacatgaggaacagacgcagatccagattgctctcctgctctcgtaacgcaatggccagccgcaagctgttaaacaaggattcgctcccgtaaggtgcgccattggcaacgatcacgattttttgcattatttactcctgtattcagggaattagacactcatcttctatcttactgcttctgcagcgtctgaccaatcggtcacatttttaaggattttcctgaaagcgcgagaaaatacgacaaaagttgccagtaatcgttattctttaaggctatggtttttcattattaccggaagttaccgacgttttgagccgtttcgttcctcgcattatcccgttttatttactcttgcttgtagcaggcggtacagctaacgcacaatctaccttcgagcaaaaagcggcaaatccctttgataataacaatgatggtctgccggatttaggcatggctcccgaaaatcatgatggggaaaaacactttgctgaaattgtgaaagatttcggcgaaaccagtatgaatgataacgggctggatactggcgagcaggcaaaagctttcgcattgggaaaagtccgcgacgcgcttagtcaacaggttaatcagcacgtagagtcctggctatcaccgtggggaaatgccagtgttgacgtcaaagtggataacgaaggacatttcaccggcagtcgtggaagctggtttgtgccgttacaagataatgatcgttatctcacctggagccagcttggtcttactcagcaggataatgggttggtgagcaatgtgggcgttgggcaacgctgggcgcgcggcaactggctggtgggttataacactttttatgacaacttgctggacgaaaatcttcagcgagcgggctttggtgccgaagcgtggggcgaatatttgcgattatcggcaaacttttatcagccgtttgctgcatggcatgaacagacagccacgcaggaacaacggatggcgcgcgggtacgacctgacagctcggatgcgcatgccgttctatcaacacctcaataccagtgtcagcctagaacagtattttggtgatcgtgttgatttgtttaactctggtacgggttatcacaatcccgtcgcgttgagtctgggattaaattacacccctgtgccattagtcactgtgacggcccagcataaacagggtgaaagtggcgaaaatcaaaataacctcgggctgaatcttaattaccgctttggtgtaccgctcaaaaaacaactttctgcgggcgaggttgccgaaagtcagtcgttacgtggtagtcgctatgacaatccgcagcgaaataatctaccgactcttgagtaccgacagcgaaaaacgttaacggtgtttctggcgacaccgccgtgggatctaaaacctggcgaaacagtgccgctgaaattacaaatccgcagtcgttacggtattcggcaactgatttggcagggcgatacgcagatattaagtttgacgccgggcgcacaagccaacagcgcggagggctggacgctgatcatgcctgactggcagaacggggaaggggcaagcaatcactggcgattgtctgtggtggtggaagataaccaggggcagcgtgtctcctccaatgagatcacgctaacgcttgtcgaaccgttcgatgcattgtcaaacgacgaactgcgctgggaaccgtaatcagaaaatgcgctcctgatgcacccataccgctgcttccacgcgagacttgagcttcattttcttcagcatgtgcttgacgtgcacttttactgtgctttcggtgatatccaggcggcgggcaatcatcttgttcggcaaaccctgggcaatcagcttgagaatatcgcgctcgcgtggggttaactggttaacatcgcgctcagtagtggcacggttagcgcgcaagctggcggccagaacaggcgttaatgcttcgcttaataccatttcgccagcagctgcctgatgcaatgctttcagcagatcttccggttccatatcttttaacagatagccatccgcgccgcgtttcagtgcggtgaccacatcttcttcatggttagagacgctgaataccacaatgcgccctgagagggacttttcgcgcagtttatccagcgtttccagaccgttcatgccgggcatattgagatctaacaggatcagatcgggatcaagagactccgccagttcaataccctgttcgccattactcgcttcgccaaccacggtgatatctggtgccatactgataagctgttttacgccagttcgcagcatcgggtgatcgtcaatcagcaggatagtagccggttcctgattactcatgggtatctccttggacgtctgtgaaagttttttcgggaataaaggtgaccaccacttcggtgccacctgattcacgacggcggacgcggcaatcgcctcgtaaactttgcgcacgatcgcgcattattatcatgccgtagtgattgctgcggatggcattttcaggcacgccgcagccgttatcctggacggtcagtttgacctgattatcgttttgcgccaccgtcaccacgacttcactcgcttgcgaatgtttgagggcgttacttaatgcctcacgggcaatttgcaacaagtggattgcctgatgcgaaggcaccaggcgaggcggcaattgataatccagcttcaccgggaagccaaatttggcgctgtactcttcgcaactcgcctccagcgccggacgtaatccaggctcggtgagctgcaagcggaatgtggtgagcaattcacgcaactgcgcccaggatgcattcagttcgttacggatctgacttaacagttcgcggctgctttctggcagcgcatcgccctgcatctgtaaacaactcacctgcatcttcatgcaagagagagattgggcaatagaatcatgcagttcgcgcgcaatggtggcacgctcttccatcacgatcaactgttgctgacgttcctgatggcgatccagcgccagcgtggcggtgagttgttcaaccagggtatccaccagttgttgttgatcatggctaagatgacgcccctgcggcagggtcgccagcaaaataccgtactgcgtatgagagtcagccagccgccacttcagggtcgtgccgcgatcaccaacgggtaatacgccgcgcgggcagagctggcagcctttatcatcacaagtcatatctggctggcaggtaaactcctgatgattctcttcatcatcagtgtcatacacccgcaattcgatatcacgtagcagggttaaattctgtaagccgttgagtacaggtgacaggcgttcacacagcggggcgcgggaatgcaaacggcggttagcctgccataaaaaagagaggatctgatttttatgctccagcccggcggttttctcctgaacccgctgctcaagtacggcataactttcggccagttctgcagacatattgttcaacgcagttccaagcatcgccatttcgttgcgcccgctgatgtttgcgcgttgggtaaaatcgcgatgactgacggcactcgccattgccagcagttgccgccacggttgtagcagtcgcgcccgcaaccagataatagtgaacaccagtaaaagtgccataaataccgccattacccgatggaccagtaccactgtctcgatgcgcatttccgtggtgcggtcaaaaccagataccagttgatcaagcccggcaacaaactggctgacatccgctgacaccgtttctcggttttgtgcacgcatcagcgcagggatcagttcattacgccagtaatcttgtaaaccctgtaattgcgccagttgtccgtctcgttctgctgctcgagtcaactcggcgctaaatgccgtttgttccatctctttaattaagggcttgtctttctcgcttaatggcactgccgccaacagacggtaactttgcatgcgcagcgatcccgctttgttgatcgcatgggcgctgccctgaacgccttgcaccagccagccagaaaccgccatccctgccagtccaatagcagtagaaagcaacacaataagcgcaacctgattaaccagggtgagcggagagagacaacgtttaagcatgtaaacctcttccttcaggctttaaatgagcaataaccttaatgaatgtgacgatacattctggaatggcagtattctcggctattggctgaagtatacccatacccggaaagagttactccttatttgccgtgtggttagtcgctttacatcggtaagggtagggattttacagcaccgtgaaaaatctcataatttttatgaagtcactgtactcactatgggtaatgataaatatcaatgatagataaagttatcttatcgtttgatttacatcaaattgcctttagctacagacactaaggtggcagacatcgaaacgagtatcagaggtgtctatgagtcactcatccgcccccgaaagggctactggagctgtcattacagattggcgaccggaagatcctgcgttctggcaacaacgcggtcaacgtattgccagccgcaacctgtggatttccgttccctgtctgctgctggcgttttgcgtatggatgttgttcagcgctgttgcggtgaacctaccgaaagtcggctttaattttacgaccgatcagctatttatgttgactgcgctgccttcggtttctggcgcgttattacgtgttccatactcctttatggttcctatcttcggtggtcgtcgctggacggcgttcagcaccggtattctgattattccttgcgtctggctgggttttgccgtgcaggatacctccacgccttatagcgtcttcatcatcatctctctgctatgcggctttgctggcgcgaacttcgcatccagtatggcaaacatcagcttcttctttccgaaacagaagcagggtggcgcgctgggtctgaatggtggtctgggaaacatgggcgtcagcgtcatgcagttggttgctccgctggtggtatcactgtcgattttcgcagtatttggtagccagggcgtcaaacagccggatgggactgagctgtatctggcgaatgcgtcctggatatgggtgccgttccttgccatcttcaccattgcggcgtggtttggcatgaacgatcttgctacctcgaaagcctccatcaaggagcagttgccggtactcaaacggggtcatctgtggattatgagcctgctgtatctggcaaccttcggctccttcatcggcttctccgcgggctttgcaatgctgtcaaaaacgcagttcccggatgttcagattctgcaatacgctttcttcgggccgtttattggtgcgctggcgcgttctgcaggtggtgcattatctgaccgtctgggcggaactcgtgtcacgctggtgaactttattctgatggcgattttcagcggcctgctgttcctgaccttaccgactgacgggcagggcggaagcttcatggcgttcttcgcggtcttcctggcgctgttcctgacagctgggctgggtagtggttccactttccagatgatttcagtgatcttccgtaaactgacaatggatcgcgtgaaagcagaagggggttctgacgaacgtgcgatgcgtgaagcggcaaccgacacggcggcggcgctgggtttcatctctgcgattggcgcgattggtggcttctttatcccgaaagcgtttggtagctcgctggcattaacgggttcgccagtcggcgcaatgaaggtatttttgattttctatatcgcctgcgtagtgattacctgggcggtatatggtcggcattctaaaaaataaaccgttactcgtcatacttcgggttacatgtgctgcggctgcgttcattcaccccagtcacttactttagtaagctcctgggattcattcacttgccgccttcctgtaaaccgaattatatagagtaaaatatttgattatcctttgcgcggcatgatgtcgcgctttttttatgcgtcatttagttacaacatactaatgttatatggtttatttcgccggatttcattaagagccattaatatgttacccatggggaatactccttaatacccatctgcataaaaatcttaatagtttaaataactacaggtataaaacgtcttaatttacagtctgttatgtggtggctgttaattatcctaaaggggtatcttaggaatttactttatttttcatccccatcactcttgatcgttatcaattcccacgctgtttcagagcgttaccttgcccttaaacattagcaatgtcgatttatcagagggccgacaggctcccacaggagaaaaccgatgagtaaattcctggaccggtttcgctacttcaaacagaagggtgaaacctttgccgatgggcatggccagcttctcaataccaaccgtgactgggaggatggatatcgccagcgttggcagcatgacaaaatcgtccgctctacccacggggtaaactgcaccggctcctgcagctggaaaatctacgtcaaaaacggtctggtcacctgggaaacccagcagactgactatccgcgtacccgtccggatctgccaaaccatgaacctcgcggctgcccgcgcggtgccagctactcctggtatctttacagtgccaaccgcctgaaatacccgatgatgcgcaaacgcctgatgaaaatgtggcgtgaagcgaaggcgctgcatagcgatccggttgaggcatgggcttctatcattgaagacgccgataaagcgaaaagctttaagcaggcgcgtggacgcggtggatttgttcgttcttcctggcaggaggtgaacgaactgatcgccgcatctaacgtttacaccatcaaaaactacggcccggaccgtgttgctggtttctcgccaattccggcaatgtcgatggtttcttacgcatcgggtgcacgctatctctcgctgattggcggtacttgcttaagcttctacgactggtactgcgacttgcctcctgcgtctccgcaaacctggggcgagcaaactgacgtaccggaatctgctgactggtacaactccagctacatcatcgcctgggggtcaaacgtgccgcagacgcgtaccccggatgctcacttctttactgaagtgcgttacaaagggaccaaaactgttgccgtcacaccagactacgctgaaatcgccaaactgtgcgatctgtggctggcaccgaaacagggcaccgatgcggcaatggcgctggcgatgggccacgtaatgctgcgtgaattccacctcgacaacccaagccagtatttcaccgactatgtgcgtcgctacaccgacatgccgatgctggtgatgctggaagaacgcgacggttactacgctgcaggtcgtatgctgcgcgctgctgatctggttgatgcgctgggccaggaaaacaatccggaatggaaaactgtcgcctttaataccaatggcgaaatggttgcgccgaacggttctattggcttccgctggggcgagaagggcaaatggaatcttgagcagcgcgacggcaaaactggcgaagaaaccgagctgcaactgagcctgctgggtagccaggatgagatcgctgaggtaggcttcccgtactttggtggcgacggcacggaacacttcaacaaagtggaactggaaaacgtgctgctgcacaaactgccggtgaaacgcctgcaactggctgatggcagcaccgccctggtgaccaccgtttatgatctgacgctggcaaactacggtctggaacgtggcctgaacgacgttaactgtgcaaccagctatgacgatgtgaaagcttataccccggcctgggccgagcagattaccggcgtttctcgcagccagattattcgcatcgcccgtgaatttgccgataacgctgataaaacgcacggtcgttcgatgattatcgtcggtgcggggctgaaccactggtatcacctcgatatgaactatcgtggtctgatcaacatgctgattttctgcggctgtgtcggtcagagcgggggcggctgggcgcactatgtaggtcaggaaaaactgcgtccgcaaaccggctggcagccgctggcgtttgcccttgactggcagcgtccggcgcgtcacatgaacagcacttcttatttctataaccactccagccagtggcgttatgaaaccgtcacggcggaagagttgctgtcaccgatggcggacaaatcccgctataccggacacttgatcgactttaacgtccgtgcggaacgcatgggctggctgccgtctgcaccgcagttaggcactaacccgctgactatcgctggcgaagcggaaaaagccgggatgaatccggtggactatacggtgaaatccctgaaagagggttccatccgttttgcggcagaacaaccagaaaacggtaaaaaccacccgcgcaacctgttcatctggcgttctaacctgctcggttcttccggtaaaggtcatgagtttatgctcaagtacctgctggggacggagcacggtatccagggtaaagatctggggcaacagggcggcgtgaagccggaagaagtggactggcaggacaatggtctggaaggcaagctggatctggtggttacgctggacttccgtctgtcgagcacctgtctctattccgacatcattttgccgacggcgacctggtacgaaaaagacgacatgaatacttcggatatgcatccgtttattcacccgctgtctgcggcggtcgatccggcctgggaagcgaaaagcgactgggaaatctacaaagccatcgcgaagaaattctccgaagtgtgcgtcggccatctgggtaaagaaaccgacatcgtcacgctgcctatccagcatgactctgccgctgaactggcgcagccgctggatgtgaaagactggaaaaaaggcgagtgcgacctgatcccaggtaaaaccgcgccacacattatggtcgtagagcgcgattatccggcgacttacgaacgctttacctctatcggcccgctgatggagaaaatcggtaatggcggtaaagggattgcctggaacacccagagcgagatggatctgctgcgtaagctcaactacaccaaagcggaaggtccggcgaaaggccagccgatgctgaacaccgcaattgatgcggcagagatgatcctgacactggcaccggaaaccaacggtcaggtagccgtgaaagcctgggctgccctgagcgaatttaccggtcgtgaccatacgcatctggcgctgaataaagaagacgagaagatccgcttccgcgatattcaggcacagccgcgcaaaattatctccagcccgacctggtctggtctggaagatgaacacgtttcttacaacgccggttacaccaacgttcacgagctgatcccatggcgtacgctctctggtcgtcagcaactgtatcaggatcaccagtggatgcgtgatttcggtgaaagcctgctggtttatcgtccgccgatcgacacccgttcggtgaaagaagtgataggccagaaatccaacggcaaccaggaaaaagcgctcaacttcctgacgccgcaccagaagtggggtatccactccacctacagcgacaacctgctgatgctgactttaggtcgcggtggtccggtggtctggttgagtgaagccgatgccaaagatctgggtatcgccgataacgactggattgaagtcttcaacagcaacggtgctctgactgcccgtgcggttgtcagccagcgtgttccggcagggatgaccatgatgtaccacgcgcaggaacgtatcgttaacctgcctggttcggaaattacccaacagcgtggtggtatccataactcggtcacccgtatcacgccgaaaccgacgcatatgatcggcggctatgcccatctggcatacggctttaactactatggcaccgtaggttctaaccgcgatgagtttgttgtagtgcgtaagatgaagaacattgactggttagatggcgaaggcaatgaccaggtacaggagagcgtaaaatgaaaattcgttcacaagtcggcatggtgctgaatctcgataagtgcatcggctgccacacctgttcagttacctgtaaaaacgtctggaccagccgtgaaggcgtggaatatgcgtggttcaacaacgtggaaaccaagccgggccagggcttcccgactgactgggaaaaccaggaaaaatacaaaggcggctggatccgtaaaatcaacggcaaactgcagccgcgcatgggtaaccgtgccatgctgctgggtaaaatcttcgctaacccgcatctgccggggatcgacgattattacgagccgttcgattttgactatcagaacctgcataccgcgccggaaggcagcaaatcgcagccgattgcccgtccgcgttcgctgattaccggggaacggatggcgaaaatcgaaaaagggccgaactgggaagatgacctgggcggtgagtttgacaaactggcgaaagacaagaacttcgacaacatccagaaggcgatgtatagccagttcgaaaacaccttcatgatgtatttgccgcgcctgtgcgaacactgcctgaacccggcatgtgtggcgacctgcccgagcggtgcgatttacaagcgtgaagaagatggcatcgtcctgatcgaccaggataaatgccgtggctggcgtatgtgcatcactggatgcccgtacaaaaaaatctacttcaactggaagagcggtaagtctgagaagtgcatcttctgctatccgcgtattgaagcgggtcagccgaccgtgtgctcagaaacctgtgtcggtcgtatccgttatcttggcgtgctgttgtacgatgccgacgctattgaacgtgcagccagcaccgagaacgagaaagatctttaccagcgtcagctggacgtgttcctcgatccgaacgatccgaaagtcatcgagcaggcgattaaagacggtattccgctgagcgttattgaagccgcacagcagtcgccggtttataaaatggcaatggaatggaaactggcgctgccgctgcatccggaatatcgcacactgccgatggtctggtacgtgccgcctctgtctccgattcagtctgcagcagacgcgggtgagctgggtagcaacggcattctgccagacgtcgaaagcctgcgtattccggtacagtatctggcgaatctgctgaccgccggtgataccaaaccggtactgcgcgcactgaaacgtatgctggcgatgcgtcattacaaacgtgctgaaaccgttgacggtaaagttgatacccgtgcgctggaagaggtcggtctgaccgaagcccaggcacaggagatgtaccgttatctggcgattgctaactacgaagatcgctttgtggtgccgagtagtcatcgtgaactggcacgggaagccttcccggagaaaaatggctgcggctttacctttggtgatggctgccacggttcagataccaaattcaatctgttcaacagccgtcgtatcgatgccatcgatgtgaccagcaaaacggagccgcatccatgatcgaactcgtgattgtatcgcgtctccttgaatatccggatgctgccttatggcagcatcaacaagagatgtttgaggcgattgccgcgtcgaaaaatctgccaaaagaggatgcccatgcgctgggcattttcctgcgcgatttaacgacgatggatccgctcgatgcccaggcgcagtacagcgaactgttcgaccgtggccgcgccacgtcactgttgctgtttgaacatgtgcacggcgaatcccgcgaccgcggccaggcgatggtggacctgctggcgcagtacgagcagcacggcttgcagttaaacagccgcgaattgccggaccatctgccgctgtatctggagtacctggcgcagctgccgcaaagcgaagccgtggaaggtttgaaagatatcgcgccgattctggcattgctgagcgcgcgtctgcaacagcgtgaaagccgttatgccgtgctgtttgatctgctgctgaaactggcgaataccgctatcgacagcgacaaagtggcggaaaaaattgccgacgaagcgcgcgatgatacgccgcaggcgctggatgctgtctgggaagaagagcaggttaaattctttgctgacaaaggctgcggtgattcagcaatcactgcgcatcagcgtcgctttgccggtgccgtcgcgccgcaatatctgaatatcaccaccggaggacagcactaatgcaattcctgaatatgttcttctttgatatctacccgtacatagccggggcggtcttcctgattggtagctggctgcgttatgactacgggcagtacacctggcgcgcggcgtccagccagatgctggatcgcaaagggatgaacctggcgtcgaacctgttccatatcgggattctggggatttttgtcggtcacttcttcggtatgctgacgccgcactggatgtatgaagcctggctgccgattgaagtgaaacagaaaatggcaatgtttgctggtggtgccagcggcgtgctgtgtctgattggcggcgtgctgttgctgaaacgtcgtctgttcagcccacgcgtgcgtgcaaccactaccggagcggatatcctgatcctgtcgctgctcgttatccagtgcgcgctgggcctgttgaccattccgttctccgctcagcatatggacggtagcgagatgatgaaactggttggctgggcgcagtcggtggtgaccttccacggtggcgcttctcaacacctcgatggtgtggcgtttatcttccgtctgcacctggtgctggggatgacgttattcctgctgttcccgttctcgcgtctgatacacatctggagcgtaccggtggagtatctgacacgtaagtaccagctggtgcgcgctcgtcactaagcgaattttagttcacatagaccctgcttcggcggggtttttttatgggcacggtgcggggtgagttgtcggatgcgcttcgcttatccgacctacaggggaggatattgtaggcccggtaaacgtggtgccatcgggcaaaattagctcggagtaacaggttttgattatttaaggaagcgatggtggtgggggaaggattactcagcgctgcgcgcttcgcccttcgggtcgttgcctgcggcaacgctctctcgctggcgctcaagtcgaaccttggtcgaagcttctcatccttccccgcttgggcagaatatttgattgcggattcgtttgagaattccggggcttttgaaagtgatggtggtgggggaaggattactcagcgctgcgcgcttcgcccttcgggtcgttgcctgcggcaacgctctctcgctgacgctcgagccgaaccttagtcgaagcttctcatccttccccgcatgggcagaatatttgattgcggattcgcttgagagttcagggacttttgaaagtgatggtggtgggggaaggattactcagcgctgcgcgcttcgcccttcgggtcgttgcctgcggcaacgctctctcgctggcgctcgagtcgaaccttggtcgaagcttctcatccttccccgcatgggcagaatatttaattgcggattcgttgggaagttcagggacttttgaaagtgatggtggtgggggaaggattcgaaccttcgaagtcgatgacggcagatttacagtctgctccctttggccgctcgggaaccccaccaggggtaattcaaattttgaggtaatgcttgagatggtggtgggggaaggattattcgtcgcttcgctcctcacccttcgggccgttgcctgtggcaacgttctctcgctttcgctcgaatcgaaccttagtcgaaggttctcacccttccccgatgagtgcaaactttcacaatctcaccgaagttaccacatcgctgtggtgaattatggtggtgggggaaggattcgaaccttcgaagtcgatgacggcagatttacagtctgctccctttggccgctcgggaaccccaccacggggtaatgctttttactggcctgctcccttatcgggaagcggggcgcatcatatcaaatgacgcgccgctgtaaagtgttacgttgagaaaaatgaactggttgcgtaattttcatccgtaacggattaaaggtaaccagttatttttgctggcgattaaagaataatcgttcgattaccgtaaacaaagacgcgctgtgccagtactttgtatagtgcacgacttaagacgtttttctcgacgtcacgacctgcgcgcatcatatcttcagctgtgtaggtatgatcgacatgaataacgtcctgcatgatgattgggccttcgtccagattgtcattcacatagtgagcggttgcgccaataatcttcacaccacgttcataggcctggtgataaggacgtgcgccaataaacgctggcaggaatgaatggtgaatattgatgatcttattcgggaagcgtgccacaaattccggcgttaatacccgcatatacttcgccagcaccacgtagtcaggttgataagcatcaatggcatccgccatcttttgatcgtgctcgttgcgggttaacccttcatggcttaccagctcaaacggaatatcaaaacgctcaaccagagaacgtaaagtatcgtggttaccaataactgccgcgatttcgacatccaggccgccgtaattggctttcatcaacaaatcgccaaggcaatgcgcttctttagtgaccagaatcactatccggcgacgaccggcaggattcagctcacgcacggagccttctggcaatgcgctatcgagatccgccagcagggtggaatcattaaaaatcccttccagttccgtgcgcataaaaaagcgcccggtacggtgatcaacaaattcattgttctgtacgatatttaactcgtgcttgtagcaaatattggtaatacgtgcgatcagacctttttggtccggacaaatagtacgcagaactttacgttggagtgaatgcattgctggaaaaaccttgttgagagtgtttgctaaaccgtaccgtcaaccattattggccgcagcactttttaaattttttacctgaaccacaagggcagggatcgttgcgaccaaactgcggacgtgtaccgtcaatatagtaccattgaccgttttctttcaaaaatcgcgaacgttcaattattgcacctgttttaccaccttcggtaaatcgagcaacaaaactgacaaatccgatattgtcggcgtcctgccaacaatgttcaaatacggtcaatcccaaccattcagtatgcgcaaatccggccatcaattcggcacgtaacgccgctgctccacaagagggatgccaggtctttattaaataatctgcgtcttgcatcacaaaagcgcagtaacgcgaacgcatgagatgttctggatcaggtgcaaccttttcaccagacacataagggtggcaacataggctatactcgacagcactaccacagggacaaagctgagacacaaataatctccctggaaacaataacggcgtattaaccgcctgagtagcactatgttaaccgagcagtagcgatgtggctacgattgcattccaggggaatcttgcgggaataatgagaaagataaaaatagggctggcgctgggatctggcgcggcgagaggttggtcgcatattggcgttattaatgcgctaaaaaaagtgggtattgaaattgatatcgttgcaggatgttcaattggttcgctggtgggcgctgcctatgcatgcgatcgattatctgcgctggaagattgggtgacctctttcagttattgggatgttttacgcctgatggatctctcctggcagcgcggtgggttactgcgcggcgagcgtgtcttcaatcaataccgcgaaataatgccggaaacagagatcgaaaattgttcccgtcgctttgcggctgttgccaccaatttaagtacgggacgtgaattatggtttactgaaggcgatctccatcttgctattcgcgcatcatgcagtattccaggactcatggcacctgttgcacataacggctactggctggttgatggagcagtcgttaacccaattcctatttccctcacgcgtgcattgggggctgatattgtgatagcggttgacctgcagcacgatgctcatttgatgcaacaagatttgctctcctttaatgtcagtgaagaaaatagcgagaatggtgattctctgccgtggcatgcgcgtctgaaagaaaggttaggcagcataacgacacgtcgggcggtgacagcgccaacggcaacagagattatgaccacttctatccaggtgctggagaaccgccttaaaaggaaccgcatggcaggtgatccgcccgatattctgattcaacctgtttgcccgcaaatatctacgcttgatttccatcgcgcgcacgctgccattgcggccggacagctggcagtggaaaggaaaatggacgaacttttgccgttggtacgcaccaacatttgaccagaatttttatctacacttaagttaattctgacaggcgcaggtggcaatagcatgccactattgagtaaagccagtcaggggagagaacatgacgcagccattggtcggaaaacagattctcattgttgaagatgagcaggtatttcgctcgcttctggattcatggttttcctcattgggagcgacaacggtactggcggctgatggggtggatgcccttgagttgctgggaggtttcactccagacctgatgatatgtgatatcgcgatgccacgaatgaacgggcttaaactgctggagcatatacgtaacagaggcgaccagaccccagttctggtgatatctgccactgaaaatatggcagatattgccaaagcgttacgtctgggcgttgaagatgttttgctgaaaccagttaaagatctgaatcgcttgcgcgagatggtttttgcctgtctctatcccagcatgtttaattcgcgcgttgaggaagaggaaaggctttttcgcgactgggatgcaatggttgataaccctgccgcagcggcgaaattattacaggaactacaaccgccggttcagcaggtgatttcccattgccgggttaattatcgtcaattggttgccgcggacaaacccggcctggtgcttgatattgccgcactttcggaaaacgatctggcattttattgccttgatgtcacccgagctggacataatggcgtacttgctgccttgttattacgcgcattgtttaacggattattacaggaacagcttgcacaccaaaatcaacggttgccagagttgggcgcgttattgaagcaggtaaaccatttacttcgtcaggccaatctgccggggcagtttccgctattagttggctattatcatcgcgaactgaaaaatctcattctggtttctgcgggtctgaatgcgacgttaaataccggcgaacaccaggtgcaaatcagtaatggtgttccgttaggcactttaggtaacgcttatttgaatcaattgagccagcgatgcgatgcctggcaatgccaaatatggggaaccggtggtcgactgcgcttgatgttgtctgcagaatgagcaaacgataacgcgggctaaatttgcattacctgctaatgtcggctggtggtactatcgtcgccattcgtataagtaattgtcttaattatgctaactcgcctccttttcagaacttagccccttcggggtgctgatatactgggatgcgatacagaaatatgaacacgttcaaaacacgaacagtccaggagaatttaaatggctgccattaatacgaaagtcaaaaaagccgttatccccgttgcgggattaggaaccaggatgttgccggcgacgaaagccatcccgaaagagatgctgccacttgtcgataagccattaattcaatacgtcgtgaatgaatgtattgcggctggcattactgaaattgtgctggttacacactcatctaaaaactctattgaaaaccactttgataccagttttgaactggaagcaatgctggaaaaacgtgtaaaacgtcaactgcttgatgaagtgcagtctatttgtccaccgcacgtgactattatgcaagttcgtcagggtctggcgaaaggcctgggacacgcggtattgtgtgctcacccggtagtgggtgatgaaccggtagctgttattttgcctgatgttattctggatgaatatgaatccgatttgtcacaggataacctggcagagatgatccgccgctttgatgaaacgggtcatagccagatcatggttgaaccggttgctgatgtgaccgcatatggcgttgtggattgcaaaggcgttgaattagcgccgggtgaaagcgtaccgatggttggtgtggtagaaaaaccgaaagcggatgttgcgccgtctaatctcgctattgtgggtcgttacgtacttagcgcggatatttggccgttgctggcaaaaacccctccgggagctggtgatgaaattcagctcaccgacgcaattgatatgctgatcgaaaaagaaacggtggaagcctatcatatgaaagggaagagccatgactgcggtaataaattaggttacatgcaggccttcgttgaatacggtattcgtcataacacccttggcacggaatttaaagcctggcttgaagaagagatgggcattaagaagtaacatccgtatcggtgttatccacgaaacggcgttgagcaatcgacgccgtttttttatagcttattcttattaaattgtcttaaaccggacaataaaaaatcccgccgctggcgggattttaagcaagtgcaatctacaaaagattattgcttgatcaggaaatcgtcgagggatttaccttgctcatccattgcttttttgattacagctggagtacggccttggccagtccaggttttagtttcgccgttttcgtcaacgtagctatattttgccggacgctgagcacgtttagctttggtgccagatttaacggcagcaaggctattcagcagttcgttcgggtcaataccgtcagcgatcagcatttcgcgatattgctgcagtttacgagtgcgctcttcaacttcagcagcagccgcgctttcttcttcgcgacgttcgttaacaacaacttctaatttttccagcatttcttccagcgtttcaagtgtacattctcttgcctgcgcacgaagagtacggatgttgttcagaattttaagtgcttcgctcattgtagtaatctcaaacttatattggggtggtttgttgaggtaataatagagccttaaattcagttgtgcaatagccaggaatgtaaggaattcaaaattgttctttattttgtgccgccaataaatatcttttcataaaattagccagaaaagacgcggcatatagccctatttacaccgatgatttcgcagcacgtgaggttaaaacttcctgattcatgtcacattttatggggagattatcgtaggctgacgacctttcagtcttctgtattagttgtgtttacgagaattccctattaagcgaatgatgaaaagtagaacagtcgcaataagagcatggacttagtattgcactatctcctggaggtcaacagagggctattacttgcgcaacaggttaaagattgtgaatagttaccagcagtcatttacccgcttataacaagcgaggcagttgtaatgatagctcagaaggattatgcaaggcttcgtaagggagaacgcatatacccacttctgtgcatactgttgagctgaaaaactgacgaattatgataaactccagccaactttatttcatatcattgagggcctgtggctgatggcacagctatatttctactattccgcaatgaatgcgggtaagtctacagcattgttgcaatcttcatacaattaccaggaacgcggcatgcgcactgtcgtatatacggcagaaattgatgatcgctttggtgccgggaaagtcagttcgcgtataggtttgtcatcgcctgcaaaattatttaaccaaaattcatcattatttgatgagattcgtgcggaacatgaacagcaggcaattcattgcgtactggttgatgaatgccagtttttaaccagacaacaagtatatgaattatcggaggttgtcgatcaactcgatatacccgtactttgttatggtttacgtaccgattttcgaggtgaattatttattggcagccaatacttactggcatggtccgacaaactggttgaattaaaaaccatctgtttttgtggccgtaaagcaagcatggtgctgcgtcttgatcaagcaggcagaccttataacgaaggtgagcaggtggtaattggtggtaatgaacgatacgtttctgtatgccgtaaacactataaagaggcgttacaagtcgactcattaacggctattcaggaaaggcatcgccacgattaataagaatttctttactgacagggtgagcagggcacttttatcctgtcagttcgttttacgcacttcttccgggctatatacccttctcggcagttttttaacgccgctatacgcctcacagggctcttaagcaccgacgttgacttgtgacctgtaaagtacaatatccctgtgtttaggcgttatacatcgtcgcaaatatgatgaaggctaatgctgtcggtttatggaaaagttgctttgggtaaacaaaaaatacggccccagaagggcaatgccgttcacttaagaggagcggcactatgtttcacaggataacgggtttttgatatcttaaccgacctcggccttgatggtcgggggcgttttgttatgaacaccacttccagagcaccccgaagatgctccagtcgtttcgggatggtccctggtgacgccgtgtttcccagctctatcatttctgatgcgatattcttccacgcaggcagtagccagtggcggttacaacccttctggttcagcgtcagcagcaggtcttcgctgtaaaaaagtttatcaaacaacgtaatagagttatccgggatggtggcgagcatggagtgggccagcacagtttcgctctgccggtaaggtgcggtcacggcattcagcagaatgtgacttcccaggttcattaaggccaccagacgcataaccgggtaggcgttctgccgcttagtggatgtgttggcagacccataatattcacgcagctcgggtttatcaggtgtcctgaactgtgcgccatcaatggcaaaaagttgcaggccgtgccagtcatccttcaggtaacgttccgcgcccctgtctgtgcggtctggcggaagagccattccactggggcggcccccacgcgctgacgcgcctgggtgacagcgctgcgggccagcaggttcatccccgcttcgccatccgcgctcaggttcagacggcgaacaacatcggtaattggctcattgcaccaccatccagataaccatgtcccccggtaaacgacggcggcgaacggtcgcatgagcagaaagcgtcaggcagtgttgtatccactcggtgggaaggtgttctgcaaatagttgtgcagagggcggaggcataagcggatggtcactgaaatcgagcagatcattgagaagtggcataagaaaacggctccctgttgtggaagccgttatagtgcctcagtttaaggatcggtcaactaatccttaactgatcggcattgcccagaaggggccgtttatgttgccagacagcgctactgattaagcggattttttcgcttttttctcagctttagccggagcagcttctttcttcgctgcagtttcaccttctacataatcacgaccgtagtaggtatccagcagaatctgtttcagctcggagatcagcgggtaacgcgggttagcgccggtgcactggtcatcgaatgcatcttcagacagtttatccacgttcgccaggaagtctgcttcctgaacgccagcttcacggatagatttcggaatacccagttcagctttcagcgtttccagccatgccagcagtttctcgatcttagcagcagtacggtcgcccggtgcgctcagacccaagtggtcggcaatttcagcataacgacggcgagcctgcggacggtcatactggctgaatgcagtctgcttggtcgggttgtcgttcgcattgtagcgaataacgttacaaatcagcagggcgtttgccagaccgtgcggaatatggaactgggaacccagtttgtgcgccattgagtgacatacacccaggaaggcgttcgcaaacgcgatacccgcgatagtcgctgcactgtgaacacgttcacgcgctaccggatttttagacccttcgtggtaggacgctggcagatattctttcagcagtttcagtgcctgcagagcctgaccatcagagaactcagatgccagtacagaaacataagcttccatggcgtgagttactgcgtccagaccaccgaaagcacacagggacttcggcatgtccataaccaggttggcgtcgacaatcgccatatccggagtcagcgcatagtctgccagcggatatttctgaccagtagcgtcgtcagttacaaccgcaaacggagtgacttcagaacctgtaccagaagtggtggtgacagcgatcattttcgctttcacgcccattttcgggaacttgtagatacgtttacggatatccataaagcgcagcgccagctcttcgaagtgagtttccggatgttcgtacataacccacatgatcttcgcggcgtccatcggggaaccaccacccagcgcgataatcacgtctggtttgaaggagtttgccagttctgcacctttacgaacgatgctcagggtcgggtccgcttctacttcgaagaagacttcagtttcaacgcctgctgctttcagtacggaagtgatctgatcagcataaccattgttgaacaggaagcggtcagtcacgatgagcgcacgtttgtggccatcagtaatcacttcatccagcgcgattggcagggagccacggcggaagtagatagatttcggaagtttgtgccacaacatgttttcagctcgcttagcaacggttttcttgttgatcaggtgtttcggaccaacgttttcagagatggagttaccaccccaagaaccacaacccagagtcagggaaggtgcgagtttgaagttatacaggtcaccgataccaccctgagacgctggggtgttaatcaggatacgcgccgttttcattttctgaccgaagtaagaaacgcgagccggttggttatcctggtcagtgtacaggcaagaggtatgaccgataccgcccatagcaaccagtttctctgctttttctaccgcgtcttcgaaatctttagcgcggtacattgccagagtcggggacagtttttcatgtgcgaacggttcgctttcatcaacaacggtcacttcaccgatcagaatcttggtgttttctggtacagagaagcctgccagttcagcaattttataggctggctgaccaacgatagccgcgttcagcgcaccgtttttcaggataacatcctgaacagctttcagctctttaccctgcaacagatagccgccgtgggttgcaaaacgttcacgtacagcgtcataaacagagtcaacaacaacaacagactgttcagaagcacagattacgccgttgtcgaaggttttggacatcagtacagatgcaactgcacgtttgatatcagcagtttcatcgataacaactggagtgttgcccgcgcctacaccgatagctggtttaccggagctgtatgcggctttaaccatgcccggaccaccagtcgcgaggatcaggttgatgtctgggtggtgcatcagtgcgttagacagttcaacagaaggttgatcgatccagccgatcagatctttcggagcaccggcagcgatagcagcctgcagaacgatatcagccgctttgttggtggcatcttttgcacgcgggtgcggggagaagataatggcgttacgggtcttcagactgatcagcgatttgaagatagcagttgaagtcgggttagtggtcggaacgataccgcaaataataccgattggttcagcgatagtgatggtaccaaaagtgtcgtcttcagacagaacaccacaggttttttcatctttataggcgttgtagatatattcagaagcaaagtggtttttgatcactttatcttcgacgatacccatgccggattcggcaacggccattttcgcgagtgggattcgagcatctgcagcagccagagcggcggcgcggaagattttgtctacttgctcttgagtgaaactggcatattcacgctgggctttttttacacgctctacgagtgcgttaagttcagcgacattagtaacagccataatgctctcctgataatgttaaacttttttagtaaatcatctgctcgaatacgagagtatagtcagtgcggtgatgatttgcttaacctatgaaaatcaaaagcttactcgcgctcacactcactgtgatttactaaaagagtttaaacattagagttattatctctaatgcgtcacttccaggtggcgtaagcaagattactcacttctgggtactgattacgtgatccaaatcaaatttttgcaaagctgacacctttcagcatcgcttttcgccattatagctaacagttaataaattgtagtatgatttggtggctacattagcatgttttgcacaactagataacaataacgaatgatagcaattttaagtagttaggaggtgaaaaatgctgtcaaaaggcgtattgtcagcgcgtcttttcaaccttatttatggctaacattatccggcttttgcttcggagctaaccgtgattcagaccttttttgattttcccgtttacttcaaatttttcatcgggttatttgcgctggtcaacccggtagggattattcccgtctttatcagcatgaccagttatcagacagcggcagcgcgaaacaaaactaaccttacagccaacctgtctgtggccattatcttgtggatctcgctttttctcggcgacacgattctacaactttttggtatatcaattgattcgttccgtatcgccgggggtatcctggtggtgacaatagcgatgtcgatgatcagcggcaagcttggcgaggataaacagaacaagcaagaaaaatcagaaaccgcggtacgtgaaagcattggtgtggtgccactggcgttgccgttgatggcggggccaggggcgatcagttctaccatcgtctggggtacgcgttatcacagcattagctatctgtttggtttctttgtggctattgcattgttcgctttatgttgttggggattgttccgcatggcaccgtggctggtacgggttttacgccagaccggcatcaacgtgattacgcgtattatggggctattgctgatggcattggggattgaatttatcgttactggtattaaggggattttccccggcctgcttaattaattcctttcaaatgaaacggagctgccatgctccgtttacttcgtcattatttttactttgttcccgcgcagttatcaaaagcaaaaggaataggtaaaaatattcttctcaaattacagttagttataaggatttccttaactgcttctcctcaccatcatgttattttcgccacatcataatcctgggcttgctgaagaataattgaaatgatattattaattccactgcctttggtagaggaaagtgctaaataataatcaattgttaaattattgtgcatttcactactggaactgtaatcagaaaagatagacatgcttagccaatctctatttgattgaattgaaagatgtttgttaaggcatggatgcaagctatagattctgatacggtcaataaaagagaattgcttaacaattttgcaaaatgtattggcgagtaagaaccgcatttggtactttccgggcaaccgccagacgattctttattggtaatgagaataattaacaattaaagagcgtcgcgaaagaataatgtgtctcgacaggggagacacagtacgaatcgacataaggtgatcgtctgaatcaccagaataaataaagtcggtgatagtaatacgtaacgataaagtaacctgacagcagaaagtctccgagcctgtgcagggtcccaatccgggattacacatgctggttaataccagtaattataatgagggagtccaaaaaacaatgaccaacatcaccaagagaagtttagtagcagctggcgttctggctgcgctaatggcagggaatgtcgcgctggcagctgatgtacccgcaggcgtcacactggcggaaaaacaaacactggtacgtaacaatggttcagaagttcagtcattagatccgcacaaaattgaaggtgttccggagtctaatatcagccgagacctgtttgaaggcttactggtcagcgatcttgacggtcatccagcacctggcgtcgctgaatcctgggataataaagacgcgaaagtctggaccttccatttgcgtaaagatgcgaaatggtctgatggcacgccagtcacagcacaagactttgtgtatagctggcaacgttctgttgatccgaacactgcttctccgtatgccagttatctgcaatatgggcatatcgccggtattgatgaaattcttgaagggaaaaaaccgattaccgatctcggcgtgaaagctattgatgatcacacattagaagtcaccttaagtgaacccgttccgtacttctataaattacttgttcacccatcaacttcaccggtgccaaaagccgctatcgagaaattcggcgaaaaatggacccagcctggtaatatcgtcaccaacggtgcctataccttaaaagattgggtcgtaaacgaacgaatcgttcttgaacgcagcccgacctactggaacaacgcgaaaaccgttattaaccaggtaacctatttgcctattgcttctgaagttaccgatgtcaaccgctaccgtagtggtgaaatcgacatgacgaataacagcatgccgatcgaattgttccagaagctgaaaaaagagatcccggacgaagttcacgttgatccatacctgtgcacttactattacgaaattaacaaccagaaaccgccattcaacgatgtgcgtgtgcgtaccgcactgaaactaggtatggaccgcgatatcattgttaataaagtgaaagcgcagggcaacatgcccgcctatggttacactccaccgtatactgatggcgcaaaattgactcagccagaatggtttggctggagccaggaaaaacgtaacgaagaagcgaaaaaactgctggctgaagcgggttataccgcagacaaaccgttgaccatcaacctgttgtataacacctccgatctgcataaaaagctggcgattgctgcctcttcattgtggaagaaaaacattggtgtaaacgtcaaactggttaaccaggagtggaaaacgttcctcgacacccgtcaccagggtacttttgatgtggcccgtgcaggctggtgtgctgactacaacgaaccaacttccttcctgaacaccatgctttcgaacagctcgatgaataccgcgcattataagagcccggcctttgacagcattatggcggaaacgctgaaagtgactgacgaggcgcagcgcacagctctgtacactaaagcagaacaacagctggataaggattcggccattgttcctgtttattactacgtgaatgcgcgtctggtgaaaccgtgggttggtggctataccggcaaagatccgctggataatacctatacccggaatatgtacattgtgaagcactaatggcaatacgtggggcaggagtgtcctgctccacggtgtctgatttttatcgcattacagaaggcacaggccagaaggtagggcaatgttaaaatttattctacgtcgctgtctggaagcgattccgacgctatttattcttattactatttcgttctttatgatgcgcctcgcgccgggaagcccttttaccggcgaacgtactttaccgccagaagtgatggccaatatcgaagcgaaatatcatcttaatgatccgatcatgacacagtatttcagctacctgaaacaactggcgcacggtgatttcggtccatcgtttaaatataaagattattcggtcaatgacttggttgcatccagttttcccgtttctgccaaactgggagccgcagcatttttccttgcggtaatactgggtgttagtgctggcgttattgccgcattaaaacaaaacaccaaatgggactataccgtgatggggctggcaatgaccggggttgttatccccagttttgtggttgcaccattattagtcatgatatttgcgatcattttgcattggctgccgggcggtggctggaatggtggggcgcttaaattcatgatattgccgatggtggcgttgtcactcgcttatatcgccagtattgcgcgtattacccgtggctctatgattgaagtattacactccaattttattcgtactgcccgggcgaaagggttacctatgcggcggatcattttacgtcacgcattaaaacctgctctgttacccgtgctctcttatatgggccccgcatttgtcggcattattaccggttctatggttatcgaaaccatttatggtttgccggggattggacaactgttcgttaatggcgcattgaaccgtgactattccttagtgttaagcctgaccatcctggttggtgctttaaccattttgtttaatgccattgtcgatgtgctatatgcggttatcgacccgaaaatccgttactgatactggagctcgcgatgatgttaagtaagaaaaacagcgagacgctggaaaatttcagtgaaaagctggaggtcgaagggcgcagcttgtggcaggacgcacgtcgacgttttatgcataaccgtgcggcggttgccagtctgatagtgctggtgctgatcgcgttatttgtaatcctggcaccgatgctttcccagtttgcctatgacgatactgactgggcgatgatgtccagcgccccggatatggagtccggtcactactttggtactgactcatccggtcgcgacctgcttgtgcgcgttgcgattggcgggcgtatctcactcatggtcggtgttgctgcggcactggtggctgtggtcgtcgggacactttatggttcgctttccggttatctgggcggtaaagtggattcggtaatgatgcgtctgctggaaatcctcaactccttcccattcatgttcttcgtcattttgctggtgacctttttcggtcaaaacatcctgctgattttcgtggcgataggcatggtttcctggctggatatggctcgtattgtgcgtgggcaaaccctgagtctgaagcgcaaagagtttattgaggcggcacaagttggcggtgtatcgacatcgggcattgttattcgccacattgtgccgaatgtactcggtgtggtggtggtctacgcatcacttctggtgcccagcatgatcctctttgaatctttccttagcttcctggggttgggtacgcaagagccgttaagcagctggggtgcattgctgagtgatggcgcgaactcgatggaagtctctccatggttattgttgttcccagcgggattcctcgtggtgacgctgttttgtttcaactttatcggcgatggcttgcgtgatgccctcgacccgaaagatcgttaaggagtgcagccatgagcgtaattgaaactgcaactgtgccgctcgcacaacaacaggctgacgcactgctgaacgtgaaagatttgcgtgtcacctttagtaccccggacggcgacgtcacggcggtcaatgatttgaatttttccctacgtgccggagaaacgctgggtattgtaggtgagtctggttcgggtaaatcgcaaactgcatttgcgttgatgggcctgttggctgccaacggacgtattggcggatcggcaaccttcaatgggcgtgaaatcctcaatttgccagagcatgaactcaataaactgcgcgctgaacaaatctcaatgatttttcaggacccaatgacttcgttgaatccctatatgcgcgtcggtgagcagttgatggaagtgctgatgctgcataagaacatgagcaaagctgaggcgtttgaagagtcggtgcggatgctcgatgcggtaaaaatgccggaagcgcgtaaacgcatgaaaatgtacccgcacgaattttctggcggcatgcgtcagcgagtcatgattgcgatggccttgttatgtcgacctaagctgctgattgcggatgaaccaacaactgcgctggacgtcaccgtacaggcgcagatcatgacgctattaaatgaactgaagcgggaatttaataccgccatcattatgatcacccacgatcttgtcgtggtggcggggatctgcgacaaagtgctggtaatgtacgccgggcgcacgatggaatatggcaacgcgcgcgatgtcttttatcaacccgttcatccttattctatcggtttgctcaacgcggtgccgcgtctcgatgcggaaggtgaaacaatgttgaccatcccgggtaatccgccaaacctgctgcgattaccgaaaggttgcccgttccagccacgttgtccgcatgcgatggaaatttgtagtagcgcaccgccgctggaagagtttacgcctggccgtctgcgtgcttgctttaaaccggtggaggaactgttatgaatgctgtaactgaaggaagaaaagtcctccttgaaatcgccgatcttaaagtgcactttgaaatcaaagatggcaaacagtggttctggcaaccgccgaaaacgctcaaagccgtcgatggtgtcactcttcgcctgtatgaaggggaaacattaggtgtggtaggggaatcgggatgcggtaagtccacctttgctcgcgccatcatcggtttggtcaaggcgaccgacggtcatgttgcctggttaggtaaagagttgctgggcatgaaacccgatgaatggcgtgccgttcgcagtgatattcagatgattttccaggatccgttggcatcgctaaacccgcgtatgaccatcggcgagatcatcgctgaaccactgcgtacttatcatccgaaaatgtcacgccaggaagttcgcgagcgcgtgaaggcgatgatgctgaaagtcgggttattgcctaacctgattaaccgctatccgcatgagttctctggtgggcagtgccagcgtatcgggattgcgcgtgctcttattcttgaaccgaagctgattatctgtgatgagccggtgtcggcgctggacgtgtcaattcaggcacaggtggtcaacctgctccagcaattgcaacgtgagatgggattgtcattaatttttatcgctcatgacctggccgtggtaaaacacatttccgatcgtgtgttggtgatgtatctcggccatgcggtagaactggggacctatgatgaggtctaccacaatccactacatccttacaccagggcattgatgtcggcagtccccatacctgatccggatctggagaagaacaaaaccatccagttactggaaggggaattaccgtcgccgatcaacccgccttccggttgtgttttccgtacccgttgcccgattgccggtccagagtgcgccaaaacacgtcctgttctggaggggagtttcagacactccgtttcttgcctgaaagtcgatccgctttaaaaacaataagggctgacagttgtcagccctttttcacgctaaaagcgattatttattcccgccagatgatatggcaaagtttgtgatctttttcgcggcataacagaatgcgggcaaaaacatcgttgatttcaccatcttcactgtccgccagaccaatcaccacttcggcaaaaaagtccgggttcaaatcgaaatcaacatgttcctgccagtcttccgccggatcgaataactccgcgccgccgcgctcttcaaactgaagattgaacagcagaacatcagctggatcgagattgtcggcagccagttcgagaaaaatatcgtaggcctgttcaagcgtttcatcttcagtcaggcgattgtttagatccatatccatagttactacctgtttaacctctgttggcgacgttttacagcaacggactgaagaagtaaaacagtcgctcggcgacacgttgccataatggacgttttagccataaacgggcatcgagcagacgtgaacgcgaaatataatcgtcctgaacggcggcgaggtcagcaccaaaacctttatcgtcgattgccagggtaatctcgaaatttagccacagactacgcatatcaaggttaactgtgccaaccagacttagttcgccatcgaccagcacgctcttggtatgcagtaacccgccttcaaactgataaattttaaccccagcagccagcagttccgtaaagaatgcgcgactggcccagccgaccagcatcgagtcattttttcgcggaaggataatactgacatccaccccgcgctgcgccgccgtgcaaatcgcatgaagtaaatcatcgcttggcacaaagtagggcgtggtcatgatcaaatattcacgcgccgaataagccgcagtcaataatgcctggtgaatgagatcttccggaaagccggggccagaagcaattgtgtgaatggtgtgaccgctggcctgttcaaacggcataatattgacatctggtggtggcggcagaatacgttttccggtttcaatctcccagtcgcaggaataaataatccccatcgcggtggcgatagggccttccatacgcgccatcagatcaatccattgccctacgcccgcatcttgtttgaagtagcgaggatcgaccatattcatgctgccggtgtacgcgatgtaattatcgatcatgatcatcttgcgatgttggcgcaggtccatacggcgtaaaaacacacgcatcagattgacctttaaggcttcgaccacttcaataccggcattacgcattagctcgggccacgggctgcggaaaaaagccacactcccggcggagtcgagcatcaatcggcaatgaatgccgcgtcgcgcagccgccattaatgattcagccacctggtccgccatgccgccgggctgccagatataaaacaccatctcaatattatggcgcgcgagctggatgtcgcggattaacgcctgcatcacatcatctgactcggtcatcagttgtagctgattccctttgaccccagcgatcccctgacgacgctcgcaaagcttgaataatggcgcagcgacactgctattttcttcggcgaagatatgcttacaggctttaaggtcgttaagccattttgcggtggaaggccacatcgctctggcgcgctcagcgcggcgtttgcctaaatggagctcgccaacggcaagataggcaataattccgactaacggcagaatgtaaataatcaacagccaggccatcgcggagggaactgcgcgtcgtttcattagaatgcgtaaagttacgcctgcaatgagcaaccagtatcccagaatggccaaccaactcaccaacgtataaacggttgtcatagattagaaatccttttgaaagcgcattgttatgagtttacgcatatggattcatctggcaaataaaaacgcgggaaaagcactggtcagcgtcgggggtgggggtataatgaccattctgttattgcatagagtagttaacatgaagcggagtagaacggaagtggggcgctggcgcatgcagcgtcaggctagccgacgtaaatcgcgttggcttgaggggcaatcgcgccgaaatatgcgtatccacagcatcaggaagtgcattctaaacaaacagcgtaactcgttattgtttgcgatctacaatatctaaatgtactgggcaccattgcggtgcccaataagtttactcttccgtctttaaactctatttttgcgccgattctttactgtcagctttcgtttctagttcatcgttatcgctgaaaataccatgacctgagttcaacaacattgaaacgagcatatcattattaatctcttcaccatttaaaactcgcgccagaatttcgctgccaaacagttgcggtgagagaatgatatccggatgtaccatcttaatcttattcaggtttttgctatcactgacggcgagaactgttttgacatcactgctcatatcttttgccgagagtacaacaaacgcgttatctgcatcgttatcactcagcgccagaatggcccggcaacgatcgattcccgctttctttaatacagaactgtcattactgtcaccggggataacatcagcattatcgcctaagcgttgctcaagttgcttgatatcatcttcaggcaagttgctgataaccgttacgttttgtccgcgttgattcagttgcaggatcgtattgatggcgagaatcgaatgtccgcaaacaataaaatgatctttacgatgcattgtatgattgtttccttttacaagtttgttgaatcccccgcggataagcggaccaaaaattgaggtcatagatgtggcaaaaacggtaatgccggaaataatgaccgaaatagtgaacaatcgtgctgattcagaaacagggacaatatcgccatagccgacggttgacatggtttctatcgaaaaatagaacgcggtcatcaaactttctattcgcggattaaaaccttcgcttaaataaagcgcaccgtaggttgagtaaaacagtaatgtcgtgaaactaataaatgcaaaaattgtcccggctgcggcgctactgtgggagaagtctttgcgcagtatcagcaaaaacaccagcgtaaaaatgcaaaatccaatactaaatttcagccagggataaaaatgcagggtgtaaattagcgctatcaacaacaaaatgatactgattgcccatgcgagctttgcccggaacagtaagccaatggagttcaggacaagaaagacgccgagcataaagagtggggcgtttgccagcaaggagagatccaactctgaaaatgctttgatatggaaaatatcaagcaaattgaccgacataccatagattgttttaaaaataagcaatccatttaaaaagacggccagcgcgagaatgtcgtgccgaagggtcacccataaatttgttgctgtttgtttgaatgtagcccagtgactcactgatacctctgtaaccacaattttgtttaattatcttagcgtgcacattttctgaacatacatgcagcgcgtgaatgtgttaaacaatagtagatgactttatccgcagtaatcaaaggatttgagcgagcaactgtacctcaggaaaggtcatttttcctgaatatgctcacatcatataaagaaatacagataaagttattatctgcttgtggtggtgaatgcactgaccggctataaggaaaggccaaacaagaacacggttgcaaaaaccgtgcccttaaatattgaatctctattcagaacactttcttaaatggtttcactgaaacgtgttcatagactcctgccgctacgtacgggtcagcatcggcccaggcctgagctgcttccagcgattcaaattcagcaataacggttgagccagtaaatcccgcagcccctggatcgttactgtctaccgctggcattggaccagctgtcaacaaacgaccttcatcatgcagtaactgtaaacgtgctaaatgtgccggacgaacggaaaggcgtttttcgaggctatcagctttgtcttgagcgtaaataacatacaacacgggcacaactccttgttcgggaaagttgtaaagtacgttatttgaaagggcgaagatctgcaacggaaagatgatgtctttgttaaggccatgcataaagtaagggtaattacgccaaaaatgacattttcactgatcctgatcgtcttgccttattgaatatgattgctatttgcatttaaaatcgagacctggtttttctactgaaatgattatgacttcaatgacccttgatttacctcgccgcttcccctggccgacgttactttcggtctgcattcatggtgctgttgtggcgggtctgctctatacctcggtacatcaggttattgaactacctgcgcctgcgcagccgatttctgtcacgatggttacgcctgctgatctcgaaccgccacaagccgttcagccgccaccggagccggtggtagagccagaaccggaacctgagccgatccccgaaccgccaaaagaagcaccggtggtcattgaaaagccgaagccgaaacctaagccaaaaccgaagccggtgaaaaaggtacaggagcagccaaaacgcgatgtcaaacccgtagagtcgcgtccggcatcaccgtttgaaaatacggcaccggcacgcctgacatcaagtacagcaacggctgcaaccagcaagccggttaccagtgtggcttcaggaccacgcgcattaagccgtaatcagccgcagtatccggcacgagcacaggcattgcgcattgaagggcaggttaaagttaaatttgacgttacgccggatggtcgcgtggataacgtacaaatcctctcagccaagcctgcgaacatgtttgagcgtgaggtgaaaaatgcgatgcgcagatggcgttatgagccgggtaagccaggcagtgggattgtggtgaatatcctgtttaaaattaacggcaccaccgaaattcagtaagcagaaagtcaaaagcctccgaccggaggcttttgactattactcaacaggtaaggcgcgaggttttccttcaggatcaaccgcgacatacttaaataatgcttctgtcgctttatagcgttgcccaattggttcagacgctacttttttcacccacacttcaatattaatgctgaccgatgtcgtccctttctggacacagcgtgcatagcagcacaccacatcgccgaccgcaaccggccgtaagaaagtcattccttcaacccgcacagtcactacgcgaccgtgggcaatttcttttgccagaatagcgccgccaatatccatttgtgacattaaccaaccaccaaagatgtcaccattggcattggtatcggcgggcatggctaaagtacgtaaaacaagatcgccctgagggacgttatgtgttgtagacatggtaaaaccgacttaaaaggaaaatcacaggcgcgatgctactatgattttcctgaggagaacagaggagatacagcgccagccccgaaggactggcagtctggttaggatttatcttcctgcggcatgtggcggtagatatagataccgcttaacaatgtgaagattaaggtaagggcggtcaggccaaagactttaaagttgacccaaatattttgcggcagccagaatgcgatgtagatgtttgccagaccgcaaaggataaagaaaacagcccaggccagattcagcttcgaccataccggttgcggcagcgtgagttctttacccagcatccgctgaattagcggctttttcatcacccattggctgactaacagggctcccgcaaatagagcataaatgacagtaaccttccatttaataaactcatcattgtggaagaacagcgtcaagccaccgaagacgaccaccagaacaaaagtgatcagggccatcttctcaaccttacgaaagcgaacccagctatagataagcacaatcgccgtggcgacgatcagcgccgcagtagccgcatagatgtcataaatcttgtaaaacgcgaaaaagacaaccagcggtaaaaaatcaagaaactgcttcattttacgattccgtaatcaaatgcttaaggttattggcgaatcaacatatacaggcggaacagatagatgagcaatatggctgaaatcaggttgctcaaggtgttcgccagtacggcaccaatttccggggttaatgcggcaaaagaagaggcaaaaagcagcaacagtgtttttgccagcaaccagctcagtactgcgggtgccaccagacgcatattcgcccaagtcagccgcatactgctacgcatcgaggcaaaaacgcccattttgtcctgtaccaacatcaccggtgccagggccagtaaaatggccatgataattcccggaacgaccaccagcatgatgccaatctgtactaaaagggtagtcagaaaaatcagaataaataactttggcaatatcggcgcactggcaccaatagctcgcagcgcactgactctctgacccgcagacaccagctggataattaatattacgcctccggcgagaatggcgttaccgattaatcctgaaaaagtggacgccgctgaagcctgcagcaaaatttgttgctgttccggtgacatattctgaaccaggtcgaacaacccactactgccgctaacgggcacgccgtcattgagctgcgcaagctgtgcatcactgggtgagaaaacatgccctaacaccactgtgataaacgcacatagcaacgataccaacagaatggtcataaattgattacggaagaaatttccggtgtcacggtatacggactgcgccgtgatagacatgcactctccttgagttttatgcaggtgttaattagcgggcaattgtaccctggttaagcctcgggtggcagcatcaggtcttgtatggaaaagcatatctttgtaaagcggaggtaattgctggccttcaggcatgggcaaatcgcggcaagtggcgaccgagttaatatttgcgtagcgaaaatatttaaaaattgatttaaatcacattaaccaggattctcaatgcaacttctaaattaatccagatcaataaagggtgaattatcatatgtaatgtgatctatgtaggatcatttgttactccaatgtaggtatattcgtcacgtttttataaccataacgacggagcggatatgaaaaagttaacagtggcggctttggcagtaacaactcttctctctggcagtgcctttgcgcatgaagcaggcgaattttttatgcgtgcaggttctgcaaccgtacgtccaacagaaggtgctggtggtacgttaggaagtctgggtggattcagcgtgaccaataacacgcaactgggccttacgtttacttatatggcgaccgacaacattggtgtggaattactggcagcgacgccgttccgccataaaatcggcacccgggcgaccggcgatattgcaaccgttcatcatctgccaccaacactgatggcgcagtggtattttggtgatgccagcagcaaattccgtccttacgttggggcaggtattaactacaccaccttctttgataatggatttaacgatcatggcaaagaggcagggctttccgatctcagtctgaaagattcctggggagctgccgggcaggtgggggttgattatctgattaaccgtgactggttggttaacatgtcagtgtggtacatggatatcgataccaccgccaattataagctgggcggtgcacagcaacacgatagcgtacgcctcgatccgtgggtgtttatgttctcagcaggatatcgtttttaattccgcacaaaaacgaccccgtaatatacggggtcaataaggacatggtataaagggtattatttcttcgcttctacgccatcagtttcagagcgaattaaaaatttctcagttgtttgcggaatattctgaatcagccagtcggccatttgcttttcctcatttaaaatcgcttcgatggttggaattgaagctgtatcaccggcattttttgctgctgctaatagtgaggtgtaacaggcgatttcaaattgctcgaagacatatccgctaatagagcctttgactatttcatcagaagggaatataccaccgattgactgcccaagcgcagccattttactcatggaatctttaatgactgaacgtgaaatgtcattacgatcaagaatagtttccagttgaacaatctggtttttggtttcactaagatgttgttcaatacgagcgcgtagttcaggataattatctatacggctggccatggattcaagcatagattcggcttgcttttccattgcgtgggcgtcacgtaaccagtcatgataatgttcaatacgattcatgaaaatgtcctctttataaaatgactaaaagttaaaattcatatttcaggctttattttcggctttcttatttacgttattaatggccagatcagtcagtttgatgtcggtggccttttcttcttccagggtttctttcagaagcttcgctgctttacggtaacctaattgttcagccagcgtcgctaatgtcccgtaactggcaatctcataatgctcgactttctgtgctgcggcaatcagtgcggcatcacgcacttcgtttttctcggtactttcgatgacctcattagcttcttcaataagaccttccattgccacacatttcatgcgcttaattttcaggttcgattcggactccacaacttgatcaatacgttcaatctgtccatgagtttcctcgaggtgcgcatgaaaagcctgacttaatttttcatttgatgttgctcttgcgagttttgccagtgcccgggttaattgtttttctgcgctgtaggtatctgaaagcaggtgaataaatacatcttcaatggtcttcatattcatatttttctccagtgaaatcactgcgagccatacggcccgcagatgcaattatctttatcagctgatattaataattaacggtgaatcaggatttgcctgatttattaccaccgctttgttgaccgccttttttacccgcttcagatgcgcgttgcggatcatttttaaaattaccgccgctatgctgaccgcctttacggcctgcgtcggatgccttctcacggtcttcggcgaaatttcctgaaccaccacgatgttcggccatgttatttctcccgttgcgttgcattgtttcattaatatgagtgttgtgtgtcgacactcattaaaattagtcgctaatgagaattagtcaaattaagcgcaacgagaagatagagggaaaatatattttgaggaacattctggatatattaacaattacctgaggaataagtgacttagagaaaattattgattttactggtgttatgttgcgggattaatttgtttgattatattactgttgggcggaaaaatgacgtaagttgacgttcgaccggggtaagcgaaacggtaaaaagataaatattaaatgaatttaggatttttccggcttcattaaagaaagttaaaatgccgccagcggaactggcggctgtgggattaactgcgcgtcgccgctttcatcggttgtacaaaaactttcagtgccgccagcattttctctggctcattaatatgttgctcgatgattttaacaatggccgaaccagaaatcgcgcccgcagctcctgcatcaatcgctgcttttacctgatccggggcggaaataccaaatccctgcaatggaggtgcagcgttgtactctttcagcttcgcaaccagatgattgaggggtaacgcggcgcggttttctgcgccggtcacgcctgctcgtgacagcaaataggtgtaaccacgaccgtaagaggctatctggcgcagcaggtcgtcatcggcatttggcgggcagatgaagataggtgcgacattatgacgcaacgcggcctggcggaagggcgcggactcttcaactggcacatcggcaaccagcaccgaatcgacgccgactttttcgcactgggcataaaactcatcaatgcctttgttaaacaccagattggcatacatcaacaggccaatgggaatggtcgggtgtttctggcgaatcagtgccagcatttcaaaacattgtgccggagtcacacctgccgcaaaggcgcgcagagtggcgttttgaatcgtcgggccatccgccagtgggtcggagaaggggatacctaactccagcgcgtcagcaccggcttcaattagcgtatcgataattttcaatgactgctcaatgcccggatcaccgagcgtgacgaaaggaacgaatgcgccttctttgcgctccttcaactgggcaaacagagattcgtagcgttccatcagatttcccctcgtgctttcaaaatatcgtgaacggtgaagatgtctttatcgccgcgaccggaaaggttaaccaccagtagctgctctttatccgggttttcgcgcatcattttcaacgcatgggccagggcgtgggaggattccagcgccgggatgatcccttcgtgcaggcacagcgttttgaaggcttcaagggcttcatcatcggtaatagacacgtaatcagcgcgtccagtgctgttaagatacgcgtgttgtgggccgacagacgggaaatccagtccggcggagatggagtaagattcttcaatctgcccgtcttcggtttgcatcatcggcgctttcataccgaaatagatacccacgcgaccatgttttagcggtgcgccgtgctcgccagtttcgataccgtgaccacctggctccacaccaatcaggccgacgttggtttcattgatgaaatcagcaaacatgccgatggcattcgaaccgccgccaacacaggcgataacggcatccggcaggcgaccttctctttccagaatctgcgctttggtttcttcgccaatcatccgctgaaactcacgcacaatggtcggataaggatgcgggccagctgcggtgcccagcatatagtgcgcggtttcgtaactaccggaccagtcgcgcagcgcctcgttacaggcatctttcagcgtcgcggaaccgctatgcaccgggatcacttccgcacccattaagcgcatacgaaaaacgttaggcgactggcgttcaacgtctttggcacccatataaatacggcatttcaggccgagcagggcgctggcaagggccgacgccacgccatgctgaccggcaccggtttcggcgatgatttcggttttacccatccgcttcgccagcaacgcctgccccagcacctggttagttttatgcgcgccgccgtgcagcaaatcttcacgcttgagatacagcgtggtgttcgtcccggctgtaatgttctggcatttggtcagcgcggttggacgcccggcatagtttttcagcaggtcgttgaactgagcctgaaattcaggatctttttgcgcactgacaaaagcttcttccagctggcgcagagcaggcatcaggatttgtggcacgtacatgccgccaaactcaccaaaataggggttaagtaatgttgtcattgttcctttccttaatatgcgcgcagcgtctggaaaaccgaggccaaaagacgtgcgtctttgatgcccggttgcgactctacagcagaattaaaatcaagtccggcgcagccggtttgtgccgcttccacgcagttatctgcgcctaagccccccgccagcagaacgttgccaagcgattgaccatttaatagtgaccagtcaaaacgttgcccgcttccaccctggccgttgtctaaaacatatttatcaacgtgctgaaactcgcgggcgggcagggtttcaccgacgcttaatgctttccagatggcaacatgtgctggcagagcttcacgcagcgtatcgatatacagctgttcttcattaccatgcagttgcactgccgccagcgataacaccttagctttgtccaccacatcggcaatatcgtgattgcggaacacgccaacatactgcaacggtgccgcagccatcacttcctgcgcctgttcaacgttgacgcaacgcggtgatgtcgcaacaaaaatcaacccaccgtaaatcgcgcccgcgtcataagctgctttagcatcttgcccacgcgtcaggccacatactttattctcacccagcaacacccggcgcacggcggcgtgcaaatcgtcatgggccatcaacgccgaaccaatcagaaaaccgttagcgaagtggcttaactcgcgcacctgagcgtaagtattgatgccggattcgctgattaccgtcacgttgtgccccagtttcggcgcaagctcgcgggtacggttgagatcaatcgacaaatcacgcagatcgcggttgttgatgccaacgacctttgctcccaatgcaatggcgcgctcctgttcctcttcattactgacttcggtcagcacccccatctccagactgtgagcgacggcggcaagctggcgatattggtcgtcatccagtactgaaagcattaataagcaggcatcggcctggtaatagcgcgccagatagatctggtaagggtcgataatgaagtctttacataaaatcggctgcggggcgatttggctgacgatggggaggaaattaaagctcccctgaaaatatttctcatcagtcagcaccgaaattgccgaagcgtaatgtttataaatggcggcaatgcgtgctggatcgaaatcatcacggatcacgccttttgacggcgacgctttcttgcactccagaataaacgccgtgcgcgcaccctgtagcgcatcataaaaatgtcgcgtgctcggctgaacctcattctgaaaactggccagcggttgctgctgtttgcgggcttctacccaaatcgccttgtctgcgacgattttcgctaaaacggtttgcatcatttaccctcgtgccgccagtgcggtgactctgtcgtaagcggaaccactgcgcagtacctcaagaacggtttgcgcattggcttgcagatcttcatggccatgcaggcgcattaacatggcgacgttcgcagcgacggctgcttcatgggcggcgtcgcctttaccttgtaacaaacgtgttaaaatgtcacggttttcttccggtgttccgcctgccagttgctcctggtggtagggtgtcaggccaaagtcttctgcggtgagctgatagcttttaatttcgccgtcatgcagttcggcaacgattgtcggcgcgtgtaatgaaacttcatccatcccgccgctgtgcaccaccgccgcgcgttgataccccagcacgcgcaaggtttcggcaatcggcagcaccagttccggactataaacaccaattaacgccagcggcggatgcgccgggttaatcaatggccccagcacattgaacagggtgcgggttttcagttgctggcgaaccggcatcgcgtggcggaatccggtgtgatacttcggcgcaaagaggaaacatacacctaactcatccagcgcctggcgcgatttatcggcgttcatatcaagattaataccgaacgccgccagcagatcggacgaaccagatttactggagacgctacggttgccgtgtttcgccactttcagcccacaggccgcggcgacaaacgcactggcggtagaaatattgatactgttgctgccgtcaccgccagtaccgacgatatcagcaaacagataatccgggcgcgggaacggcgctgcgttttccagtagcgcggttgctgccccggcgatctcgttcgggtgctcaccgcgaattttcatgctcaccagcgccgccgccagttgttccggcttcagctcgccacgcaccaccgctgaaaacagctggtggctttcttgttggctaagcgtctgcgcctgatacagtttttccagaatcggttgcagcgtgttggctggctctagtttctgctgcgcccaggccagcgtttgttccagcaggcgagcgccctgggtggtgagaatggattccggatggaactggaatccacaaacgcgatccgcatcgtgacgtactgccatcaccatgccattaaaatgggcgttgatggttaaaccggccggaatgttactgccaaccagcgagtgataacgcgccaccggcagcgggtttgttaatccggcaaacatcgcctgaccgtcatgttcaatgctggaggctttaccgtggagaatttcgcccgcctgaccgacatagcccccgtaagcttcgacaatcgcctgatgtccgaggcaaatgccaataatgggcagcttgccacgcaagcgggtgaggagttccggcatacaaccggcttcgctcggcacaccggggccaggagaaagcatcagcaccggattgctcatggtcgccaggcgttcaattaaggtttgcgccggaatatggttgcggtaaatcaccacgttatgcccattgctgcgcaactgatctgccaggttgtacgtaaaagagtcgatattatcgagcagcagaatgtcagccatcagaaagtctcctgtgcatgatgcgcggtggcaatagcgcgcagtacagcgcgggctttgttacgggtttcgtcggcttccgactgcggaacagaatcaaggactacaccagcacccgcttgcacggtggcgataccgttttccaccagcgccgagcggatcacaatgcaggtgtcgagatcgccatgcgcggtgaaataacctaccgcgccgccgtagctgccgcggcgacgaccttccgcctcggcaattaactgcatagcgcgtactttcggcgcaccgcttaacgtccccatattcatacaggcgcgataagcgtgcagggcgtcaagatcgtgacgcagttcgccgactacgcgagagacgaggtgcatcacataggaataacggtcaactttggtgagatcggcgacgtagcggctgccgggggtgcaaatgcgtgccagatcattacgggcgagatcaaccagcatcagatgttcagacagctctttatgatcggtacgcatttccagttcaatacggctgtcgagatctctgtccagtgaaccatcggcgcgacgaccgcgtgggcgtgttccggcaatcgggtagatctcaatctggcggctggtggcatcatacttgagcgagctttccggcgacgcgccaaatagggtgaaatcattatcctgcataaaaaacatgtacgggctgggattactctttttcagcacgtaataggccgccagcggtgacgggcagggcagagagaaacggcgagatggcaccacctggaaaatttctccagcgcgaatcgctttttgcaacaaacgcactacgccaccgaactcttcatcgctctgattacattcacaacgcatatgcggcacggaaaccactggcagcggcggcgcggcttcggtcagttgctgacgtagttcgttcaggcgagcagtgagacgttgtttttcttcttcattcggagcaaacaggctggcctgaatacgggtgctttttttctgatggtcaatcaccatcagcgtttcagcgagataaaaacagaaatcagggcagttattttccgctgacagttgcggtaaatcttcaaatcccgccacaaggtcataagagaacaggccgccgaagaacatggcttctcgttcttccttcggtacattcaacagattctgcaataaacggaaagcgtcaaaaaccgaaagggagcataagcgggcgtcttcatccagcagtggactgacaggggggaagcgcagcacacggcagtttggtgattgttcactttccacacccgcaggcagggcgttatccagtagtgccaggagggcttcgccgttgccggaaagtgcctggattgtgacagtgtcacctaaagctgtaatgcgcagcgcactgtctaccagcagcaggctttttaaatcatctttgctgtcgatatctgcggattccagcagcagcgttgccggacgatccccacacaactggtgaaaaagcgcggtgggattgtcgcgataagcgccttcgcaggttagcagttcgagagtcggtttttgtgtttgcattgttattctctaattttgttcaaaaaaaagcccgctcattaggcgggctgggtatctgattgctttacgcatggtgaatacactgcccgtttcaggaagtgcgccaccaacctttcagtacgaaaattgctttcattgtcgataccctttttacgtgaacttgcgtactagttaactagttcgatgattaattgtcaacagctcatttcagaatatttgccagaaccgttatgatgtcggcgcaaaaaacattatccagaacgggagtgcgccttgagcgacacgaattatgcagtgatttacgacctgcacagccataccacagcttccgatggctgcctgacgccagaagcattggtgcaccgtgcagtcgagatgcgcgtcggcaccctggcgatcaccgaccatgacaccacagctgcaatcgcgccagcaagagaggaaatttcacgttcgggactggcgttgaatcttattcccggcgtggaaatttccacggtctgggaaaatcatgaaattcatattgtcgggctgaatattgatattactcatccgctaatgtgtgagttcctcgcgcagcagacagaacggcgcaatcagcgggcgcagctgattgccgaaagacttgaaaaagcgcaaatacctggggcgctggaaggcgcacaacgactggcgcagggcggcgcagtgacgcgcggtcattttgcgcgtttccttgttgagtgcggcaaagccagttcaatggcggatgtctttaaaaagtatctggcgcgcgggaaaaccggatacgttccgccacagtggtgtacaatagaacaagctattgatgtcattcatcattctggcggtaaggcggtgctagctcatcctgggcggtacaatcttagtgctaaatggctgaaaagattggttgcgcattttgccgaacaccacggtgacgcgatggaagtcgcgcagtgccagcaatcgcccaatgaacgtacccagctggcggcccttgcgcgtcagcatcatttatgggcatcacaaggatctgattttcatcagccatgcccgtggatcgaactgggtcgtaaactctggctgcccgcaggcgttgaaggcgtctggcagctatgggaacagccgcagaacaccacagagagggaattatgagccagtttttttatattcatcctgataacccacagcaacgtctgatcaaccaggcggtggagatcgtgcgtaaaggcggggtgattgtttatccaactgattccggctatgcgctcggctgtaaaattgaagataaaaacgcgatggagcgtatttgtcgtattcgccagctgccggacggtcacaactttaccctgatgtgtcgcgatctttctgaactctcgacctattcatttgttgataacgttgcgtttcgtttaatgaaaaacaacacgccgggcaactataccttcatcctgaaggggacgaaggaagtgccacgccgtctgttgcaggaaaaacgcaaaaccatcggtatgcgtgtgccttctaaccctatcgctcaggcgttacttgaagcattgggcgaaccgatgctttccacttcgctaatgctgccaggcagcgaatttaccgaatcggacccggaagaaattaaagatcgtctggaaaaacaggtagatttgattattcacggcggctatctcgggcagaaaccgacaacggttattgatcttaccgatgatacgccggtcgtggtgcgtgaaggcgtaggtgatgtgaagcctttcttataacaaattgcgttccacggatggaagactatggcagggaagtttcgctgcattttgctgttgatagcagggctgtttgtatcatctctaagttatgcagaaaacacggagatcccttcttatgaagaagggatctcgctctttgatgttgaagccactctgcaaccagatggggtgctcgacatcaaagaaaatattcattttcaggcgcgaaatcagcagattaagcacggcttttatcgtgatttaccacgactatggatgcagcctgatggggacgctgcactgctgaactatcatattgttggcgtcacccgtgatggtattcctgaaccctggcatcttgactggcatatcgggttaatgagtattgtcgtgggcgataaacaacgtttcttgcctcaaggcgactatcattatcaaattcattatcaggttaaaaatgctttcctgcgtgagggggattctgatctgctaatctggaacgtgaccggtaaccactggccgtttgaaatttataagacccgtttttctctccagttctctaatattgcgggtaatccatttagcgaaatcgatctttttaccggagaagagggcgacacatatcgtaatggccgcatccttgaggacggaagaattgaatcccgcgatccgttttatcgtgaagatttcacggtcctctaccgctggcctcacgctttacttagcaatgcctcggctccgcaaacgacgaatattttcagccatcttcttttaccctccacgtcatcgttgttaatttggtttccgtgtctgttcctggtttgtggatggttatatctctggaagcgcaggccgcaatttacgccggtagatgtgattgaaaccgatgtcattccgccagattacacgcccggcatgttacgtctcgatgcgaagctagtttacgacgataaaggtttttgtgccgatatcgtaaatctgattgtgaaaggaaaaattcatctggaagatcagtctgacaagaaccagcaaatcctgattcgtgttaatgaaggcgcgaccagaaataatgcggtattactgcccgcagagcagttattactggaagcgttatttcgtaaaggcgataaggtcgttcttacggggagacgcaacagagtcttacgcagggcatttttacggatgcagaaattttatctgccgcgtaaaaagtcttcgttttaccggtctgatacttttttgcaatggggtggactggcaatattggcggtcattctttacggtaacttgagtcctgtaggctgggcaggaatgagtctggtgggcgatatgtttattatgatctgctggattattccttttttattttgttcccttgagcttttgtttgcccgcgatgatgacaagccttgcgttaatcgtgtaatcatcactttgtttttaccactgatttgttcaggcgtggccttctattctctctacatcaatgtcggagatgtattcttttactggtatatgccagcgggttattttaccgctgtttgcctgaccggttatctcactggcatggggtatatttttctgccaaagtttacccaaactggacagcaacgttatgcccacggtgaagctatcgttaactatcttgcgcgtaaagaggcagcaacacacagtggacgtcggcggaaaggggaaacacggaaactggattacgcgttgctaggttgggctatatcggcaaatttggggagggaatgggcgttacgcattgccccttcgctttcttcggcgattcgcgctccagagattgcccgtaacggcgttttattctcattacagacgcacctaagttgcggggccaataccagtttgttggggcgaagttattccggtggtggtgctggcggcggcgcgggtggcggaggcggtggtggctggtaattaagctgatgttaatcgaaacaagctttaaccataaagatagtgtagtatgttgcgcctcaaagccaggccgataaacgtcgagtcgtttacttaaggcctgaagagttcaaacagactttactatcagtgagtcagatgtaagttctgactcactgttgcacaaaagcatatcagacgcctgggaaggcgacaccaaaaggaagctctatgagcgaaaagctacagaaagtgctggcgcgtgccggccacggttctcgccgtgaaatcgaatctattattgaagccggtcgtgtgagtgttgatggcaaaattgctaaactcggcgatcgtgttgaagttacccctggattgaaaatccgtatcgatggtcacctgatttcggtacgtgagtccgctgaacaaatttgtcgcgttctggcctattacaaaccggaaggtgagttgtgtacccgtaacgatccggaaggacgtccaacggtgtttgaccgtctgccaaaactgcgtggcgcacgctggattgccgtgggtcgcttggacgttaatacctgtggtctgctgctgttcaccaccgatggtgaactggcaaaccgtttaatgcacccaagccgtgaagttgaacgtgaatatgccgtgcgtgtatttggtcaggttgacgacgcgaaactgcgtgatttgagtcgtggcgtgcagttggaagatggtccggcagcttttaaaaccatcaagttcagcggcggcgaagggatcaaccagtggtacaacgtgactctgaccgaaggccgtaaccgtgaagttcgtcgtctgtgggaagcggttggtgtgcaggtgagccgcctgatccgtgttcgttacggtgatatcccactgccaaaaggtctgccacgcggtggctggacggagctggacctcgcccagactaactatctgcgcgaactggtggagctaccgccagaaaccagctctaaagtcgctgtagaaaaagaccgtcgtcgcatgaaggcgaatcagattcgtcgtgcggtgaaacgtcacagtcaggtgagcggcggtcgtcgttctggcggacgtaataataacggttaatcaaagtatgccggacgtcatatccggcatttttacagattaataatcgatccctatctgcgcttttacaccggcatcaaacgcatgtttgacggggcgtaattcacttaccgtatctgccagttcaagaatatcccgatgacaaccacgacccgtgataatcaccgtctgttgatgtggacgttcatttaacgcctgcaccacttcttccagtggcaaatagtcatacgccaccatatacgtcagttcatcaagcaaaaccatatccagtgaggaatcagcaagcatccgctttgcatgttgccagacttcgcggcaggcggcggtatcagactcgcggttttgtgtatcccaggtaaagcccgttgccatcacctgaaactcaacgccatgtggctccagcagattgcgttcgccattaggccaggtgcctttaataaactgcacgacgcctactttttttccgtgaccaactgcgcgtgttgccgtaccaaatgccgcggtggttttgccttttccattgccggtaaagacgatgataataccgcgttcatcctgggcctgggccacacgagcatctactttttctttcactcgctgctgacgctgttggtagcgttcatcactcattgggaaattcctggtttacggcccggttgggcgtcaaaggtcatgccggttttacggcggctgtcatcgcccatcagccagaggtagagcggcatgatatcagcgggtgttttaagtttctgtggatcttcggtcgggaaggcgctggcacgcattgcggtgcgcgtaccgcctgggttaatgcagttgacacgcaggcgctgctgatattcatcggccagtacctgcatcatcccttcggtggcaaatttcgacgctgcatatgcaccccagttggctcgtccctgacgtccaacgcttgatgaagtaaagaccagtgaaccggcgtccgatttgagtaataaaggaagcagtgcctgggtgagcataaaggtggcattaacgttgacctgcatgacgtcctgccagacctgcggattttgttcgctcattgggcaaacatcgccgagcaatccggcattatgcaaaacaccatccagacgcggataattaacggcaatgcgctgtgccagttgttggcaattttcggacgtgcaggtcagcaaatcgagaataaaccactgtggctgacgcccagtttcttcgtttatgtggctggctacctgacgtaatttttcttcattacggcccaacagaatcactgtcgcaccatagcgtgcatacgtcatcgcggcttcacgaccaataccatcgctggctcccgtcaccaggataatgcgatcattgagtaaatcttgttttggctggtaatgcatggctactcctcaacgacgttgtctgtcgcgctgccagtgtactttatgactttggggctttatgcctgaaacagaagggcatttcaatcagcctggggcgataacaccgcaaaatggatactttgtcatactttcgctgcaataacatctctgcgagacggcttaacatgcctgttgtaaactgtgagccaaagcgttgtttaaccaaggtggggactcgtggaattgttgtctgaatatggtttgtttttggcgaaaatcgttaccgttgtgctagcgattgcggcgattgccgccattattgtcaatgttgctcaacgtaataaacgccagcgtggcgagttacgggtcaacaatctcagcgaacagtataaggagatgaaagaagaactggccgcggcgctgatggactcacatcagcaaaaacagtggcacaaagcgcagaagaaaaagcataagcaagaagcgaaagcagcaaaagcgaaagccaaactgggcgaggtggcaactgacagtaaaccccgcgtctgggtgctggattttaaaggcagcatggacgcccatgaagtgaactcgctacgtgaagagataacggctgtactcgcagcattcaaaccgcaggatcaggttgtgctccgtctggaaagccctggtggcatggtgcatggttacgggctggcggcttcgcaactgcagcgtctgcgcgataaaaacattcctttaactgttacggtagacaaagtcgctgccagcggcggttacatgatggcctgtgtggcggacaaaattgtttccgcaccgtttgctattgtgggttccattggcgtggtggcgcaaatgcccaactttaaccgcttcctgaaaagcaaagatattgatatcgaactgcacactgccgggcagtataagcgcacgctgacgttgctgggtgaaaataccgaagaagggcgggagaaattccgcgaagagttgaacgaaacgcatcagttgtttaaagattttgtgaagcgtatgcgtccttctctggatattgaacaggtggcaacgggtgaacactggtacggacaacaggcggtagagaaaggcctggttgatgaaatcaacaccagtgatgaagttattcttagcctgatggaaggccgtgaagtggtcaatgtacgctatatgcagcgtaaacgactcattgaccgattcaccggcagcgcggcagagagcgccgatcgattgttgctacgctggtggcagcggggtcaaaagccattgatgtaaaagacaaacgcgaggctaagacctcgcgttttgctttaatcaaccagatgatatttttctgaaagcacatgggccaggtgtttgaacatattaaacaccgcggtgcttttggctgttggcaatccttgttcatctaaaaagtagtcgccggtaaataccagcacgccattacgctgcgtgacgccggtggcttcaatccctgcgagcgtatcctcatgctcacgaatgattttgttggcctctttcaacagcgtttcgcggtcgatgggttgtgtctctttgttcattatttactccttaaacaaggacattagtctacgccaggcatggcttgcagacaaatataccacgctggtggcaagagcgccttactggcaactttggattttgcatgctaataaagttgcgtatcggattttatcaggtacagtgtgacgctttcgtcaatctggcaatagatttgcttgacattcgaccaaaattccgtcgtgctatagcgcctgtaggccaagacctgttaactcagtcacctgaattttcgtgaacagagtcacgacaaggggttgatatccgcagagagcgagtccatatcggtaactcgttgccagtggaaggtttatcaacgtgcgacgcattcctggaagaatcaaattaggtaaggtgaatatgggtaaagctcttgtcatcgttgagtccccggcaaaagccaaaacgatcaacaagtatctgggtagtgactacgtggtgaaatccagcgtcggtcacatccgcgatttgccgaccagtggctcagctgccaaaaagagtgccgactctacctccaccaagacggctaaaaagcctaaaaaggatgaacgtggcgctctcgtcaaccgtatgggggttgacccgtggcacaattgggaggcgcactatgaagtgttgcctggtaaagagaaggtcgtctctgaactgaaacaactggctgaaaaagccgaccacatctatctcgcaaccgaccttgaccgcgaaggggaagccattgcatggcacctgcgggaagtgattgggggtgatgatgcgcgctatagccgagtggtgtttaacgaaattactaaaaacgcgatccgccaggcatttaacaaaccgggtgagctgaatattgatcgtgttaatgcccagcaggcgcgtcgctttatggaccgcgtggtggggtatatggtttcgccgctgctatggaaaaagatcgctcgtggcctgtctgccggtcgtgtgcagtcggtggcggttcgcctggtggtcgagcgtgagcgtgaaattaaagcgttcgtgccggaagagttctgggaagtcgatgccagcacgaccacgccatctggtgaagcgttggcgttacaggtgactcatcagaacgacaaaccgttccgtccggtcaacaaagaacaaactcaggctgcggtaagtctgctggaaaaagcgcgctacagcgtgctggaacgtgaagacaaaccgacaaccagtaaacctggcgctccttttattacctctacgctgcaacaagctgccagcacccgtcttggatttggcgtgaaaaaaaccatgatgatggcgcagcgtttgtatgaagcaggctatatcacttacatgcgtaccgactccactaacctgagtcaggacgcggtaaatatggttcgcggttatatcagcgataattttggtaagaaatatctgccggaaagtccgaatcagtacgccagcaaagaaaactcacaggaagcgcacgaagcgattcgtccttctgacgtcaatgtgatggcggaatcgctgaaggatatggaagcagatgcgcagaaactgtaccagttaatctggcgtcagttcgttgcctgccagatgaccccagcgaaatatgactccacgacgctgaccgttggtgcgggcgatttccgcctgaaagcacgcggtcgtattttgcgttttgatggctggacaaaagtgatgcctgcgttgcgtaaaggcgatgaagatcgcatcttaccagcagttaataaaggcgatgctctgacgctcgttgaacttacaccagcccagcactttaccaagccgccagcccgtttcagtgaagcatcgctggttaaagagctggaaaaacgcggtatcggtcgtccgtctacctatgcgtcgatcatttcgaccattcaggatcgtggctacgtgcgagtagaaaatcgtcgtttctatgcggaaaaaatgggcgaaatcgtcaccgatcgccttgaagaaaatttccgcgagttaatgaactacgactttaccgcgcagatggaaaacagcctcgaccaggtggcaaatcacgaagcagagtggaaagctgtactggatcacttcttctcggatttcacccagcagttagataaagctgaaaaagatccggaagagggtggtatgcgcccgaaccagatggttctgaccagcattgactgcccgacttgtggtcgcaaaatggggattcgcacagcgagcaccggggtattccttggctgttctggctatgcgctgccgccgaaagagcgttgcaaaaccaccattaacctggtgccggaaaacgaagtgctgaacgtgctggaaggcgaagatgctgaaaccaacgcgctgcgcgcaaaacgtcgttgcccgaaatgcggcacggcgatggacagctatctcatcgatccgaaacgtaagttgcatgtctgtggtaataacccaacctgcgacggttacgagatcgaagagggcgaattccgcattaaaggttatgacggcccgatcgttgagtgtgaaaaatgtggctctgaaatgcacctgaaaatggggcgtttcggtaaatacatggcctgcaccaacgaagagtgtaaaaacacacgtaagattttacgtaacggcgaagtggcaccaccgaaagaagatccggtgccattacctgagctgccgtgcgaaaaatcagatgcttatttcgtgctgcgtgacggtgctgccggtgtgttcctggctgccaacactttcccgaaatcgcgtgaaacgcgtgcgccactggtggaagagctttatcgcttccgcgaccgtctgccggaaaaactgcgttatctggccgatgcgccacagcaggatccggaaggtaataagaccatggttcgctttagccgtaaaaccaaacagcaatatgtctcttcggaaaaagacggaaaggcgactggctggtcagcattttatgttgatggcaaatgggttgaaggaaaaaaataacctttaattctgtcaggtttttataaacaaagggtcgcgaaagcggcccttttttattgcatattattttttcttcacacctatacactaaggctataaatgatatagtggttatagttagcaccttttttattattaaatcgtattagtcacccgccaggtgtgacgaaaaaacgatgttctgatggcgtctaagtggatggtttaacatgaaattacaacaacttcgctatattgttgaggtggtcaatcataacctgaatgtctcatcaacagcggaaggactttacacatcacaacccgggatcagtaaacaagtcagaatgctggaagacgagctaggcattcaaattttttcccgaagcggcaagcacctgacgcaggtaacgccagcagggcaagaaataattcgtatcgctcgcgaagtcctgtcgaaagtcgatgccataaaatcggttgccggagagcacacctggccggataaaggttcactgtatatcgccaccacgcatacccaggcacgctacgcattaccaaacgtcatcaaaggctttattgagcgttatcctcgcgtttctttgcatatgcaccagggctcgccgacacaaattgctgatgccgtctctaaaggcaatgctgatttcgctatcgccacagaagcgctgcatctgtatgaagatttagtgatgttaccgtgctaccactggaatcgggctattgtagtcactccggatcacccgctggcaggcaaaaaagccattaccattgaagaactggcgcaatatccgttggtgacatataccttcggctttaccggacgttcagaactggatactgcctttaatcgcgcagggttaacgccgcgtatcgttttcacggcaacggatgctgacgtcattaaaacttacgtccggttagggctgggggtaggggtcattgccagcatggcggtggatccggtcgccgatcccgaccttgtgcgtgttgatgctcacgatatcttcagccacagtacaaccaaaattggttttcgccgtagtactttcttgcgcagttatatgtatgatttcattcagcgttttgcaccgcatttaacgcgtgatgtcgttgatgcggctgtcgcattgcgctctaatgaagaaattgaggtcatgtttaaagatataaaactgccggaaaaataatttcttgcgttattttcggcaccttttatgtagcgaaggtgccggaatatattctcttttgttacttatttctataccgtgcacaatatttttatccctcatatttatagggtaaattacctgtaaagtagtgtctaattacccgcctcgcaaactccagttttcaaatatctatttcaggtcaaaagattgaattattcactggagacgattcgtaaattcgctggatttttgactaaagtttctttaggatttgtctcatcgtatgattaattacaccaatcgttcaacgtcttgctgataagtgatggcgattatatgaggttagcaatgccttctggaaatcaggaaccccgccgcgatcctgaattaaaacgtaaagcctggctggcggtttttcttggttctgcacttttctgggtggttgtcgcactgctgatttggaaagtgtggggataactatggtcggtcaggagcaactggagtcgtcaccattatgccagcatagtgacaatgaaacagaaacgaaacgggaatgttccgtcgttattccagacgactggcaactaacatcgcagcagcaagcctttatagaactgtttgctgaagatgatcagccgaaacaataattatcatcattcttattacccatttttaatgaattaaagggcttttaatacaccgcagcaataacagcttgagttatctcaacacaaaataataaccgttaagggtgtagcctatgatcaacacaaatatgaaatattggtcctggatgggcgcgttttctctgtcgatgctcttctgggccgaactcctctggatcattactcactgatccttgaccccgctgcggcggggttgtcatttgctttgccacaaggtttctcctcttttatcaatttgggttgttatcaaatcgttacgcgatgtttgtgttatctttaatattcaccctgaagagaatcagggcttcgcaaccctgtcattaaggaggagctatgtcgtcaaccctacgagaagccagtaaggacacgttgcaggccaaagataaaacttaccactactacagcctgccgcttgctgctaaatcactgggcgatatcacccgtctacccaagtcactcaaagttttgctcgaaaacctgctgcgctggcaggatggtaactcggttaccgaagaggatatccacgcgctggcaggatggctgaaaaatgcccatgctgaccgtgaaattgcctaccgcccggcaagggtgctgatgcaggactttaccggcgtacctgccgttgttgatctggcggcaatgcgcgaagcggttaaacgcctcggcggcgatactgcaaaggttaacccgctctcaccggtcgacctggtcattgaccactcggtgaccgtcgatcgttttggtgatgatgaggcatttgaagaaaacgtacgcctggaaatggagcgcaaccacgaacgttatgtgttcctgaaatggggaaagcaagcgttcagtcggtttagcgtcgtgccgccaggcacaggcatttgccatcaggttaacctcgaatatctcggcaaagcagtgtggagtgaattgcaggacggtgaatggattgcttatccggatacactcgttggtactgactcgcacaccaccatgatcaacggccttggcgtgctggggtggggcgttggtgggatcgaagcagaagccgcaatgttaggccagccggtttccatgcttatcccggatgtagtgggcttcaaacttaccggaaaattacgtgaaggtattaccgccacagacctggttctcactgttacccaaatgctgcgcaaacatggcgtggtggggaaattcgtcgaattttatggtgatggtctggattcactaccgttggcggatcgcgccaccattgccaatatgtcgccagaatatggtgccacctgtggcttcttcccaatcgatgctgtaaccctcgattacatgcgtttaagcgggcgcagcgaagatcaggtcgagttggtcgaaaaatatgccaaagcgcagggcatgtggcgtaacccgggcgatgaaccaatttttaccagtacgttagaactggatatgaatgacgttgaagcgagcctggcagggcctaaacgcccacaggatcgcgttgcactgcccgatgtaccaaaagcatttgccgccagtaacgaactggaagtgaatgccacgcataaagatcgccagccggtcgattatgttatgaacggacatcagtatcagttacctgatggcgctgtggtcattgctgcgataacctcgtgcaccaacacctctaacccaagtgtgctgatggccgcaggcttgctggcgaaaaaagccgtaactctgggcctcaagcggcaaccatgggtcaaagcgtcgctggcaccgggttcgaaagtcgtttctgattatctggcaaaagcgaaactgacaccgtatctcgacgaactggggtttaaccttgtgggatacggttgtaccacctgtattggtaactctgggccgctgcccgatcctatcgaaacggcaatcaaaaaaagcgatttaaccgtcggtgcggtgctgtccggcaaccgtaactttgaaggccgtatccatccgctggttaaaactaactggctggcctcgccgccgctggtggttgcctatgcgctggcgggaaatatgaatatcaacctggcttctgagcctatcggccatgatcgcaaaggcgatccggtttatctgaaagatatctggccatcggcacaagaaattgcccgtgcggtagaacaagtctccacagaaatgttccgcaaagagtacgcagaagtttttgaaggcacagcagagtggaagggaattaacgtcacacgatccgatacctacggttggcaggaggactcaacctatattcgcttatcgcctttctttgatgaaatgcaggcaacaccagcaccagtggaagatattcacggtgcgcggatcctcgcaatgctgggggattcagtcaccactgaccatatctctccggcgggcagtattaagcccgacagcccagcgggtcgatatctacaaggtcggggtgttgagcgaaaagactttaactcctacggttcgcggcgtggtaaccatgaagtgatgatgcgcggcaccttcgccaatattcgcatccgtaatgaaatggtgcctggcgttgaaggggggatgacgcggcatttacctgacagcgacgtagtctctatttatgatgctgcgatgcgctataagcaggagcaaacgccgctggcggtgattgccgggaaagagtatggatcaggctccagtcgtgactgggcggcaaaaggtccgcgtctgcttggtattcgtgtggtgattgccgaatcgtttgaacgaattcaccgttcgaatttaattggcatgggcatcctgccgctggaatttccgcaaggcgtaacgcgtaaaacgttagggctaaccggggaagagaagattgatattggcgatctgcaaaacctacaacccggcgcgacggttccggtgacgcttacgcgcgcggatggtagccaggaagtcgtaccctgccgttgtcgtatcgacaccgcgacggagttgacctactaccagaacgacggcattttgcattatgtcattcgtaatatgttgaagtaacaactatttgcttgccggttattttgcttccggcaagcaaatgaattacacaatgcaagagggttatttgttcagcaaatggcccattttctcggctttggtatcgagataatgttcgttattggggttacgacctacaatcaatggtacgcgttcaacaatattaatccctgcttcggtcagaatttcgacttttttcgggttattggttaacaagcggacttcattgacgccaaggagtttgaacatatcagcgcaaagagtgaagtcgcgctcatcagcggcgaagcctaactggtggttagcctctacggtatcgtaaccttgatcctgcagtgcgtaagcgcggattttattcagcagaccaatgttacgaccttcctgacggtgatacagcaaaataccacggccttcctcggcaatttgcgtcaatgccgcttcgagctggaagccacaatcgcagcgcaagctgaacagggcgtcaccggtcagacattcggaatggacgcgcgcaagtaccggggtatgcccggaaatatcgccatagactagcgcgacatgatcgtgtccggttgccagttcttcaaatcccaccatcaggaaatcgccccatggggttggcagtttggcttctgccacacgtttaagctgcatgaaattctccagataatgctggttctgtattggcttattttgccataacgagaaggggttcacctaatcacgacgcgtcgatcgttcacggaatggcacaaatctgtcaatttttcctggaactggcgttttcagttatgattgtgggacttatcaaaaaggagaggccatgcgttcgattgccagacgtaccgcagtgggagctgcactattgcttgtcatgccagtagccgtatggatttctggctggcgttggcaacctggagaacaaagttggctactaaaagcggctttttgggttactgaaactgtcacccagccctggggcgtcattacacatttgattttattcggctggtttctctggtgtctgcgttttcgcattaaggctgcctttgtattatttgccattctggcggccgcaatccttgtgggacaaggcgttaaatcctggatcaaagacaaagtccaggaaccacgaccttttgttatctggctggaaaaaacacatcatattccggttgatgagttctacactttaaagcgagcagaacgcggaaatctagtgaaagaacagttggctgaagagaaaaatatcccacaatatttgcgttcacactggcagaaagagacggggtttgcctttccttccggtcacacgatgtttgctgccagttgggcactgctggccgttggtttgctgtggccgcgtcggcgaacgttaaccattgctatcttgctggtctgggcaacgggagtcatgggaagccgcctgctgctcgggatgcattggccacgcgatctggtagtagctacgttgatttcgtgggcgctggtggcggtggcaacgtggcttgcgcaacgaatttgtgggccattaacaccacctgcggaagaaaatcgcgaaatagcgcaacgagaacaagaaagttaacgctggttgattttccgaatttagcccttaaatcatcaacaatgcgtgtggatgccatttcgcagacggcgcgaaaatggtactttaaagggctattgcggtaagttgaccataatttattcgctctaaccacataacgggaagtaatgtgaaatatttactcattttcttactggtgttagcgatcttcgtgatttcggtcacgttgggtgcgcagaacgatcaacaggtgacgtttaattatctgttagcgcaaggggagtaccgtatttccacattgctggcggtattgtttgctgcggggtttgctatcggttggttgatttgtggcctgttctggctgcgagttcgtgtttccctggcgcgcgctgaacgtaaaataaagcgactggaaaaccagctttcacccgcgactgacgtggctgtagtgccgcactcgtcagcggcgaaggaataactttctatgctggagttgttgtttctgcttttgcctgtagccgctgcctatggctggtatatgggccgcagaagtgcgcaacaaaacaagcaagatgaagccaaccgcttgtcgcgtgattacgtagcgggggttaacttcctgcttagtaatcaacaggataaagcggtagacctgtttctcgatatgcttaaagaggatacaggcaccgttgaagcccaccttacgctcggaaacctgttccgttcgcgtggcgaagttgatcgcgctattcgcatccatcagaccctaatggaaagcgcctcgctgacctatgaacagcgtctgttggcgattcaacaactggggcgtgattacatggccgccgggttatatgaccgcgcggaagacatgttcaatcagctgaccgatgaaactgacttccgcattggcgcgctgcaacagttgctacaaatctaccaggctaccagtgagtggcagaaagcaattgatgttgccgaacgcctggtgaagctgggtaaagataaacagcgcgtcgaaattgcccatttctactgtgagttagccctgcagcatatggccagcgacgatctcgatcgtgccatgaccttgctaaaaaaaggggcggcggcagataaaaacagcgcccgcgtatccataatgatgggacgcgtgtttatggcgaaaggagaatacgccaaagccgtcgaaagtctgcaacgcgtgatatcccaggacagagaactggtcagcgaaacgctggaaatgttgcaaacctgctatcagcagttgggtaaaactgccgaatgggcagaattcctgcagcgtgcggtggaagagaacaccggtgccgatgctgaattgatgcttgctgatatcatcgaagcgcgcgacggtagtgaggccgcacaggtctatattacgcgccagcttcagcgtcatccgaccatgcgtgtgttccataagttaatggattaccacttaaatgaagcggaagaagggcgtgccaaagagagcctgatggtgctgcgtgacatggttggcgagaaggtacgtagtaagcctcgttatcgttgccagaaatgtggttttaccgcatacaccctctactggcattgtccgtcttgtcgggcctggtcaaccattaaaccgattcgcggtcttgatggcctgtaatttttaaaaaaaatccgactttagttacaacatactaattattaatgttccattgtgctccggcaacgacggcgcagaaaaagcctgccaggggagaaatcgcaactgttaattttttatttccacgggtagaatgctcgccgtttacctgtttcgcgccacttccggtgcccatcatcaagaaggtctggtcatgacgttaactgcttcatcttcttcccgcgctgttacgaattctcctgtggttgttgcccttgattatcataatcgtgatgacgcgctggcctttgtcgacaagatcgacccacgcgattgtcgtctgaaggtcggcaaagagatgtttacattgtttgggccacagtttgtgcgcgaacttcaacagcgtggttttgatatctttcttgacctgaaattccacgatatccccaacactgcagcgcacgctgtcgctgctgcagctgacttaggcgtgtggatggtgaatgttcatgcctctggtggggcgcgtatgatgaccgcagcgcgtgaggcactggttccgtttggcaaagatgcaccgcttttgattgctgtgacagtgttgaccagcatggaagccagcgacctggtcgatcttggcatgacactgtcacctgcagattatgcagaacgtctggcggcactgacgcaaaaatgtggccttgatggtgtggtgtgttctgctcaggaagctgtgcgctttaaacaggtattcggtcaggagttcaaactggttacgccgggcattcgtccgcaggggagtgaagctggtgaccagcgccgcattatgacgccagaacaggcgttgtcggctggtgttgattatatggtgattggtcgcccggtaacgcaatcggtagatccagcgcagacgctgaaagcgatcaacgcctctttacagcggagtgcatgatgagtgattccaacagccgtctggtctactcaacggaaaccggacgtattgatgagcccaaagcggcccctgtacgccctaaaggcgacggtgtggtgcgtattcagcgtcagaccagtggacgtaaaggtaagggcgtttgcctgattaccggtgtcgatctcgatgatgccgaactgacaaaacttgcagcggaactgaagaaaaaatgcggctgcggcggagcagttaaagatggagttattgaaatccagggcgataagcgtgatttattaaaatcactacttgaagcgaaagggatgaaggtaaaactcgcaggcggttaacataaaaagccacggatatatccgtggctttcgaatattttactgtgcgtattattcagttatttcgtactgaacagaatcaagcgtattataattgcgagtcgataatcgacatttatttacgattatttaccgacctggtgaccaataacacctccgacagctgcaccacctaatgtacccaacgtactgccatcggtcagtactgcaccgcctaatgcccctgcacccgcgccgattgcggtgttgcggtcccgtttagaccagttagaacaggcactcagagacattgccaaagtaattgccagaacagccgcggtcatttttttgctcgttacaaacataatactctctcctgaatttatgattcacggaagtaagctctctataactataatagctaagaataagtctggtgaaattattccgtgaaatctgctcgcgcgcagggttatatcacgcaggtgataatgacttcctgttatatcgctgataataattttatatcttgagagtgttaataacaggtaaatagtcttaattatcaaccaggaatcatcttagagcggatgatttgccaaactgcaaatcatccgtagagaagggaaatggttaaatgtcaacgacgtgaatggtgagtttactgtgctcaagatgcatcagatcgctggcgcgtattttcgaatcggtaatcacgcgattgaatcgctcaacgggaccgatggagtatgaatgtacagcaccaaatttcgagctgtcagtcaggactatcgcttcgcactctttttccagcacggcattgaccacatcggtacgcatcatatcgcgaccggtaaatccagtttcaggttgccagccatcaataccaataaatgctttgctgaaatgcacctgttggatgcactggcgtgtcaaagggccaaccatactttcgctttttttctgatacacgccaccgagcaaaataacttcacaaggcgcgtctttcagcaaatgcgcgatgtagctgctgaccgtgatgatagtgacatttttcttctgctcgcccagagtccgggcgagtagggcattgctgctgccattttcgataaagatggtttcgcccggttgaaccagcgacgcggcaaactcggcgagttcacgcttcagcgtatagttgctcatcatacgggtttcgacgtcatcactatcaagcgaaacagcaaagccatgtgcacggcggaggtaactcagtttttcgagtgtgttgagatcctggcgaatggtaacttcagaaactccagtggcttttgccagatcggttacgctaacctgaccctggtcaatgaccatctgtagaatagtttgttgtcgggaattcatcgctgtaattcttataacgttataatacttaataaaaaaatactgacgcgccgggcatcctcaaataggaaaacctgaaggcacgattgttaaatctcccacggtgccttcgggatgtctggcgtagattcagcaacctggcgcaagagttctgctttaagtatctcgagattatggatcgcagagtggtaatcgcctgccacaaggatatctaacacaatatcaatacgttcggcaacgcgctgggcatcaaattcagacatcaaggacatccttatagcaaaagggggaaaatgaataatgcaaaaattgccgctaaaagagaagtgtttaacagcaacggctaattatcatccaggaatacgatatataatgacgggatatagcgctaagtatatatattcatctacttatgcgcgcttcagatagcgtttataccagcgttcgaaggcgacggcgggcatcggtttggcaaacaaaaatccttgccgctcattgatcccgttcttggttaaaaaagcatcttcctttgcactctctacaccttcggcgatcacctgaagattcaatgcctgggccacagcgacgatcgcccggaccagtgactgcgagacaggttgtttgtgaatatctcgaacaaaaacctggtcaagtttgatggcatcgatcggaaagcgcgccagttgcgaaagtgaagagtagccggtaccaaaatcatccagatgcacttgcgcacctagttggctaaattgttgaataacagacagtgccagttcatcattctcaatcagacaactctctgtcagttcaacatctatagggcagtattcaaaattgagttcctggagaacctgtttcagggcggtgaaaatggtttgatcggcgagctgacgtgcagaaatatttaccgccactcgcaggtttatgcctttatcccgccactttgccacctggcgtacgacatcgagaatcacccaacggcctaaaggcacaattagccctgactcttcggcgtaggaaatgaagtccaacggtggaatcaacccacgttcaggtgactgccaacgtactagtgcttccagactgcgcacttcgccacgccaggtgattttcggttgatagtgaataaccaactgatcgttttccagtgctttacgcaagttggtatccagccagagatattcaaatacccgttgattcatttctggggtaaaaacgcaaaattgtcctcgtccgccttccttcgctgtgtacattgctgtgtcggcgtgacgaataatagccgtgctgtctgaaccatgttcgggagagagtgcaatacctactgaacagctggtataaacttcaattaaaccaatgcgaaaggggagccgtaagcgggtcaaaattcgtgatgccattgcttccagcgcgctttgtgaggtgttggatgccagtaccagaaactcatccccacctggacgcgccaacacctggtcatgttcgagacagcttaaaatagccaatgacacgtcgcgtaataactggtcaccaaacaaatgcccataggcgtcgttgacctttttgaaattatccaaatcaagatacacaaccccaactttattgttatctgcatgattaatagcgtgatcgattaaatcctgcattgcgttacgattcggcagtccggtgatactgtcggtatttgccagaatacgcagtcgctcctgagcgcggcgctcttcggtaatgtcggtgccggaacagattaaaaaaatctcgtttttgccactgccgctgtggacaaatttattgcgaaacagaaacagccgctggcctttacatgttggtatccacagttcgacttcatatgcattgccgcttcgaaaaaatacacggttattgcgcctggatgccgcagcttcacgacggctcataaacagtttaaacacgctttgcccaatgacgtcgtgttctttcaaccctgtgtaatcttcacataaccgattgaagcgttggatattcccccggctgtcgagaatcactattgcggaatgtgcttcagaaactacctgctcagcaaaggaaagcccgtgtgataaatcacgagcaaccgccggtgtgtcatgccatgcagacgcgttgccagcccattcccgtttattgatttttcgtcctaccagatgcacagaaagatcgctttcatcgacggtcagactcatcatcaggctggaggtgatgaccgtcatttccctgatgcgagcagcctgttcggcagataactgcaatgtacgatcaggttctgtggtttcggtggtagaaaagcgcaaaacatcgctgctttccgtcaaccgccagtatggattgtgcgatccgagaaagttgtacaacgttgtggactccctaacggttttcatgatgcatatcctccggttaacagcggagtccgcggttaaataaaaggaacaacatgacttacatgaaattaacggcggctaaacgcattgttttttttatatatttatttgtaatccagttttggaaaaacgccagttttcaaacgaaagtcagttaaaaaatctgcctggatataacgaaggtagagcggggaaataaacggcccatccatgaggaatgggccgtgaaaggagattacgcgaccgggcgcgcaataatgctgcgggtttccatgcggacttcggcaatagtgacgtcaataacgtcagtcactttgtaaaccgtttcacctttaatttgtacagtgccgttttcctggctgcaaaccagttcatcgcgcacagcgtgtaagaaaggtgccggaataaaggcgatagcgccgttatcaaccaaacgaacacgcatgccgccacggctgatatcgacaatttccgctgcgaaacgggtgtcggtcccggctttgtctttcaggaagcgtgcgtataaccagtcaccaacatcacgttctgccatccggttgagacggcgacgctcggccatttggacagtgatttcatcctgtgggcgcgtcgcagtttcgcctttgataaccgctttcagcagacggtggttgatcatgtcgccatatttacggatcggcgaagtccaggtggcgtatgcttccagaccgaggccaaagtgaggaccgggttcagtgctaatttcagcaaatgactggaagcgacgaatgcggctgtcgaggaaaccagttggttgcgcgtccagttcacgacgcagtttgcagaaaccgtccagcgtgagcacttcttcggcatcgacatgcagaccgtgcgttttcagcaacgctgccagcgcgtcggcattcgccggatcaaagcccatatgcacgttatagatgccaaaaccgagcttatcgcgcagtacgcgggccgcacaaatgttagcggcaatcatcgcttcttcgacgatacggttggcaatgcgacgaggctcggcgacgatatccagcacttcacctttttcaccgagaataaagcggtaatccgggcgatctttaaacaccagtgcgtggttatgacgccactcgccgcggcgttggcaaatttgcgctagcaaacggacttgttcggcaattgcttcactttcaggctgccagtcaccggtattttccagccagtcagaaacctggtcatacaccagctttgctttggattcgatggtggcggcaaagaattcgatattatcttcaatggtgccatcagcggagagcgtcatgcggcatgccagtaccgggcggacttcattggcgcgcagtgagcagagatcgtcagaaagctcgcgaggcagcatagggatgttgaagccaggcagatagttggtgaatgcgcgaattttcgcggctttgtccagcttgctgccttcagcaatccacgcggttggatcggcaatcgccacaatcagctgaagtttgtcatccggcaacgccttagcgaaaagggcgtcatccatatcttctgtgctggcactgtcgatggtgacaaaatccagcgcggtcagatcttcacgaaccagaccttcatcgagcatttcggtagcgacgccgtctggtgcttctttttccagattatggcgtgcaagggtaacccaccacggtacaaagtgatcgtcaccaaaagtgatgtattgtgtcagttctgcatagaaagaacgatcgcctttcagcggatgacggcgcatttcggcaaccgcccagtcgccttctttaaactcgtggttcaggccacgggctgcgcggcaaggaatggcgtcttttaagagtggatgatcaggaacgatggccagacggtcatttttgccctgaaccttacccacgaaacgagtcaggaacggttcaaccagttcttctggctctgcggattcacgttctttttcactgtggatcaccgcgataattcggtcgccatgcatgacttttttcatctgcggcggcggaatgaaataacttttttgcgcgtcgacttccaggaagccaaagcctttttctgtggcttttaccaccccttcagcgcgtggcgtctgggaatgcagttgctgtttaagctgcgctagcagcgggttgtcctgaaacataattgtctattttggtggccattagagcggctgacagttttacgcgaatctgtctgacgcggcaaggttaatatgtctcacccaacgcgatttttaagcgatttatccagccacacagcccgctccataccagcagattaataatctgcgttgatgatttttcgtgttcgagtaaagggctgaactgggcggcgctaaagcgatcgggtgctcgggtcagccattgtatcgcctgaacggtagcgcgctcaacagaatgacggtcagcccattggttaatttcattttcgcccttgcgcataagggtgctgatttttttatattcatttgatgaatccatacaggtggcaaaacaagcaggactgccatttatacgcgcgcataacaacgccgcaagctgattatccggctgtgtattgccccgtgtgctgtttaacaacttttcgagaagggaaagtgaaatagggtggagagagagtatttcggccagttggcaaagttctgcagttgaactttttgtgtgctcttcaggtagtttttccacctcatagctgcttcgccagcgtaatgattcatcagcaaacagtgacgcgtcggcgtagttttgtatctccagcccgggtaaccagcgtaccggatgcccgagataagcctgaaatgtcgcaattgtccgcgcctgaaagccaataaaaccaatgatttggctaatgatcacacagtcccaggcagtaagaccgacgtcattcagatgctggcgcgatcggttgtcgataatagaaggcgagctagccagttggcgggcatattgcgtgatttgtgccaaccgatgattactttccctggtggaatcaggcccggggagcggcgtaagtcgcgccgaatagtagttacataaccgctggacgccgcaaacctgagcaaccgtcagggccgtcgacaagcgttcataagcggtgaaggtctgtgaacgggtcacggtaagctggtcagggaacaaatccactgcaagaacacgcgcagggtccagccatgaaaggaagggggccagcgtttctttttcaaggatcacgtcgagtagaaagggatcgctgacctttgcggcttccgggaccagaggcagaacgtcatactccgtagtactggattgcgtttcatgataccagtggcttttgccggtgatgtggcgttgttccatgggcgctccttggtcgtaaaggaaatcgttatcctgacgcaaggcgggaaggggagaaagacggatcggcgataacaaatatcagaaaggtataacagagataacgggcggcagaacgccgcccatctttaccaacagaacgattatttcagttcgagttcgttcattgcagcaatgctgaaaccgccgtcaacgtggaccacttcaccggagataccggcagagagatcggagcacaggaatgccgcagagttacccacatcttcaatagtaacggtacggcgaatcggggtaacggcttcgcaatgagccagcattttgcggaagtctttgataccggaggccgccagagtacggatcggaccagcagagatggcgttaacacgcacaccttccggacccatcgcgttcgccatatagcgcacgttcgcttccagagacgcttttgccagacccataacgttgtagttcgggatagcgcgctcagcgccaaggtaggaaagggtcagcagggcagaacccggattcagcatggagcggcaagcttttgccattgcaacgaagctgtaggagctgatgtcgtgggcaattttgaagccttcacgggtaacggcgttaacatagtcaccatccagctgatcgccaggtgcaaaaccaatagagtgtacgaaaccgtcaaatttcggccaaactttccccagttcagcgaacatggtgtcgatgctggcatcttctgcaacatcgcactgcagaacgatgtcagaacccaattgagcggcaaattcttctacgcggcctttcagtttgtcgttctggtaggtgaatgccagttcagctccttcgcggtgcatcgcctgagcgataccgtaggcgatggatagtttgctggcaacaccggttaccagaatgcgcttaccggaaagaaaacccatagctttaatccttattgttgatgcttgttgtgcctgaaaatcaggcgattcgtcgttttagtaaacagtacgaacagataaacggttattataatcaacctggctgtgagtagctatagttgccaggtccgaccggagcaggctgcggcagggggggcgcttttcccctcaccctaaccctctccccagaggggcgaggggaccgtattgtgcaaatattgttaccccagcaacaaacaggctcatacagcccctaaccctttcatggcgatggctgggacggttcagaccttgccgaatattctccagcaccgtctccatgttttcaccacaacagctattcggctcggtctgccccctcgctctttcagggagagggtgaccggcggttcagttcctgcagaatattctccagcaccgtctcctcattacaatcaatctcgttattccagaaacgcagcacggtccagccctgcgactcaagccagctagtgcgcctggaatcataggcaactgctaaatcatgctgcccaccatccagctcaacgactacacgcgccgagcagcaagcaaaatcgagaatgtagctccccactggatgttgacggcgaaatttgaaatcactaaaacgtcggctgcgaagatatcgccagagctttcgttcctgcaaagtgagattgcgtcttaaatcacgcgcatttgatttaattttatctatcacctcattctgacaagatttaatcttttgtcagaatgaggtgaataatctggaaggaggattcagaaaattagcgatctttacgccacgcatccgccgtcaatgcctcgccaaaatgaccggcaatcagccgtttggtgagttcatgcagcggcgatgccagcacatccgcggtgctgcctcgctcgacaacctcgccctgatgcatcaccagcacctggtcgctaatgtgcttcatcattccgatatgctgggtaacataaatatacgaaatgccctgtttttcctgtaattccagcatcagattaatcaactgcgaacgcatcgacatatccagtgaagcgagggcttcatcggcaataatgacttttgggcgcaatatcagcgcgcgcgccagacccagacgctgtttttgtccgggtgccaacatatgcggatagtaactgacgtgatccggtagcagcccaaccatacgcatcgtttcaataatctgtttgcgacgctgttccggttccaggtcggtgttcaggcgcagtggaaaatccagaatttgcgagatacgttgacggggattcaacgaggtcgaaggatcctgaaaaatcatgcgaatacgctgactgcggaaggaataatcgccaaaatgcagtggatgatcgtcaatcaataactcgccgctggtaggctctatcattcccgccagcatttttgccagcgtggatttacccgaaccattctcgccaataatcgccagtgtctggccttcacgtagcgtaaagctcaagggttttaccgcttctacggtctgacgacgaaaccagccggtccggtagcggaacgttttacttaaattacgcacttcaagcagcgtttcgatcatctcactctttctccatgttcagcgggaaatgacaggcatagagatgatttttcgcccccgtcaaacgtggcgtcacaatgcattctcgttgtgcatacgggcaacgtggccccagacgacaaccaatcggtaactgttccagcagtgggatagcgccgggcagcgtattgaggcgacttttatgcggcatcgcgctgccgaagtctggtatcgcgcggatcagcgcctgggtataaggatgatgtggcatcgtcaccaactccttactcggcgcggtttccactgtttgaccgcagtaaagcacgttaattttatccgcccattggctaagcatttgtaagtcatggctgataagcaaaatagtggtattgctgttttggttgagacgcgtcagcaggcgaaagatttgcgcctgggttgttggctccattgagttggtcggttcgtcagcaatcagcagacgcggttgattcgccagtgcaatggctatcatcactttctgacattcaccttcggtcaactcatagggaaaactgcgcatcgcatctttgtgatctttaatccccacgcggtgcagcagttcaatggcacggcgtttgcgccagccaaaacgctgccaccaacggcctttataggtccaggctgggatgttttgcatcaactggcggcccacacgttctgaagggtcaagacacgactgcggttcctggaaaatcatcgacacgttatggccaaccagtttgcgccgttcgcgtgcggagagacgcagcaaatcgatatcatcaaaacgcatacggtcagcagtaacacgccagttatctttattcaccccacaaatcgctttcgcaatcaaactcttgccggaaccggattcaccaacaagaccgcggatttcaccttcggttaaggtcatacttacccggtcgacggctttaacccactcatcaccggttttaaattcaatggtcaggttacgaatatcgagtaatggcattattccacccccgcaataatcgcacgacgaacgccatcgccaaggaggttaaccaacaacacgctaatcataattgccgcacctggcagcatgacagtccacggggcgacataaatcagttccagcgcatcaccgagcatcgctccccattcaggcgaggggagttgtgcgccgagatcgagaaagcccagcgcggcgatatcgagaattgccatcgacagtgcgcgggtgatctcggtgaccagcccggcggtgatgtttggcatcacagcaaaccagagaatattcagcgttgatgcgccatccagacgggcggcgataacgtactctttttccagttcgtcatgcaccatgctgtaaatcgaacgtaccatacgcggcagcaatgccagccagacagcaaacatagcgtgggacaaactcggtccggcaaacgctacaacgataattgccaacagcagcgaagggatcgccagtaaggtatccagaatatggttaagcaccgctgagcggaggccgtgtgtcgccccggcgaaggtgcccagtaccaggccacagatcgtcgcggcaagcgtcaccacaaatgcgccacccacggttggcgcagctccgctcagtaaacggcttaaaacatcgcgtccgaggtcgtcagtccccaggaagaaagaaacttcgccatagcgcgaccatgacggcggcaataattgataaccgagaaattgctggtcgatgccgtaaggcgcaaaccagccgccaaaaatacacagtacagccagccccgcgcagccgtacaggccgaccatcgcagaggcgtcactataaaatttgcgccaggcggtacgcagcgtgcccggcgggcgcttttcgctgtatacgctatcgtaaggcataccattccttatgtttcagagggttagccatggcacccaaaatatcagaaatcacgttaacaataatgaccagtgagccacacaccatcactccggcggaaatggctgcgtaatcctgctggcggatggcgttaattaaccagcgccctaaacccggccagctaaaaaccatttcggtgatcatcgccagcgtcagcatggtggaaaactgtaagcccaggcgaggaataaccggcggtaacgcgttatgcagaacgtggcgacgcaaaatagtaaagcgcgacaaaccgcgggtcgccgccgcttttacatagttctggtcatacacttcgatagtgctgatacgcatcaggcggatcacttcagttgttggcgcaaccgacagggtgatcacgggcaatatcatatggcggattgcgctcatgatcatttcatcccgccatggtgagtccgaaagccaggcatcaatcaacgcaaaaccggtaatcggtttcacttcgtagagcagatcgaaacgccctgaaacgggcaaccaacctagcgtgagtgaacaaaacagcgtcaacagaagcgccagccagaacaccgggattgaaaagcccagtaaggcgatggcgttgatcaagttatcctgccacttatggcgcgtaatcccggcaatcatccccacggggatgccaacaatcagcgcaaaaccgaaggcgaggatgcacagttccatcgtcgccgggaagacctcttttaactgttcggcaatcggttgaccgttaatgctggaaacaccaaaatcccagtggatcaggccgttaaaccagaacacccaggcattccacagtgacgcgccttgtaacggcgcatgaggggtgaaatagctcaagctgaagccaacgaaggtcagcaggaacaaggtgacaatcaataacaaaatgcggcgtaaggtgaagataatcatggttttttcacctcatcctgtttctcgcgatacaccccagcaaaggaggcgttaccaaacgggctaagtaccagacctttgatatcgtaccgataggcctgcaaacgcaatgacgacgccagcggcaaaatgggcaattcctgcgccagaatactctgcgcttcgtcataggcttcaatacgcgccgccagctgctgcgaagagagcgccttacgcaatacgctgtcgaatttcggatcgcaccagtgggcgaggttggtctgcgaatgaattgccgcgcagctcagtaacggacggaagaaactgtccgggtcgttactgtccgtcgcccaaccggataacgtcagatcatggctcatatccatcaaccgcgcctcctgaaagcgaccttctaccggcacaatcaccacttttacgccaacctgcgccatatccgcctgaatcagttcggcagttttcagtggactggggttccacgcctgcgaacgtgtgggcacccacagtttcagcgttaaattttccagccccaacgacttcaactgttcgcgcgatttcgccggattgtattcagtaattttagcctcgttgtcataggcccacgaggcgcgcggtaaaatagaggccgccgtttcagccgtaccataatagatggattgcatcaggcgctggttattaatcgccagtgccagcgcatggcggacagcgggattatttagcggcggtttggcggtgttaaatgccagataggcgacgttcatcccaggacgcagcgttaaacgcaagcgcgggtcgtcacgcaaaatggatagctggctggcagcaggccaggccagaacgtcgcattccccggtcaggagtttcgacagacgtccggtgccgccggagcctaaatccaccactacctgcggcattaacggtttaccgcgccagaagtcatcatgacgttgtaggcgaataaattgcccggcgcggtattccgacaactgatacggaccggtgccgaccggttgacggtcgagttgctcctggcgatcttctttctctaacttccgggcatattctgccgacatgaccgaagcataatgggttgcgaggtgccacaaaaaagaagcatccggctgggcgagtcggaactcaacggtatgattatccagtttgcggacgcttttcacgttatcggcaaattgcaggctgtcgaagtaggggaagttgctgccgttgacgttatgccacgggttgttgcggtcaaaaattcgctggaaggtaaacaccacatcgtcggcattcattttacgagtgggagtaaaccagtcggttttttgaaacggaacatcgcgacgcaggtggaagcgataggtcgcgccgttgtcgagtacttcccagctttcggcaagttccggcatcaggcgataggtatagggatcgacatccagcagtcgatcataaaactgggcggcaagggtatcgacaattaacccactgctcgctttggatgggttaaaggtgttgacttgcccgctgacgcaatagacaaaaccgctgtcgcggatatcagcatgcgggggagattcaggcgcggcgattgcctgaccactcacaagtccagcaatcaccaaaagagacgataatacctggcgcataatattaagggattttatgtaaagaggctatcttactaatatttaatgacatttgccattaccgtttgtgttcaggggtcgtaatgagggccgtgtggttggtcgttgaacaggtgacgtcgccatctgttcaacattcgtacccgtgatttctctataactataactcacagaacaacttagcgaggagcagagcggtacgatcgtgagaaacccattaaagcacgctgcagtgcgtgtcattgttagccagatgcggcgtgaacgctttatccggacaacgatactgaccgatcgtctgcaattaaatcattactcattaccccattgattcaaaaactctgcgatctcatcaatgcgtacgggattaatccccgcttcagcagccatttcatgttgggcttcttcgctgatctcttcattgttcatcaaacgggtgagcagtaactggaagtagtgggccagcggtgtgcgttcagcctctgcgacaggctctgcgcattcggtcgcgtactcatcggcaatatcaaaatattttagcgggatatcgtggttcattatttgcccctggggttaatgcgctaagcataagggcggatgatagcactcgtgatccgggtcatacatctttttatagttaatggcgcggcgcgttaccctcaggcaggataatgcgccgcgcatccgactattacgtttcactcaccggcgttctgtcaccatcatacaacggcactttgcgatagcggcggatcagataccataaatatgcgccgcctaacgaagcccataccagaccgagtgtcagtgacgttgactcgaggttaacccacagcacacccaccgtcagcgcgccaaccagcggcatcagcaaatagtggaagtgatccttccagcttttattcattcctttacgccgccagaaatgattaaacaccgacagattcacgaaggtaaacgccaccagagcaccgaagttaattaacgctgtggcggtaactaaatcgaagaacagcgccgacaacgcgacaatcccgaccataatgacgttgagtgccggagtccgccattttgggtgcacatagccaaacacgcgctccggaaacacattgtcacgccccatcacatacagcagacgcgacacgctggcatgtgaagccaggccagaggctaacgtgttcacaaacgtggtgcagaggaaaatcgactggaagagcttgccgccgacgtacagcgcaatttcaggcagtgcggcatccggatctttaaagcggctgatatcgggaaagaacagctgcataaagaacgacgccgcgataaagataacgccaccgtagaccgccgtcaggaagatggctttcgggatcacgcgtgcggcgtccggcgtctcttccgaaagcgtggtcaccgcatcgaaaccgaggaaggagaaacagacaatcgtcgccccggtaataatcgggatcaggtgcgcgttctcgctgataaacggctgaagtgaccagacggtgccaacgccttctcctttatgcagtccctgaactaccaggaagataaacaccaccatgatggagatttgcaccagtacaaacagggtattgaagttagcgaccaggttgacgctcttcagattcgcggcggttaaaatggcgacgaaggttaccacccacacccacggcggcacttccgggaagagggcggagagatagattttcgccaacaagacgttaatcatcggcaaaaagagataatccagcagcgatgaccagccgaccataaatccgacgtgcgggttaatcgacttttgcgcgtaggtataggccgaaccggcctccggaaactggcgaaccagtttgccgtagctgatagcggtaaacagcacacccgccagcgccagcaaataggacgccggaacgtgaccgtcgctaatgccggagacaataccaaaagtatcaaatacggtcatcggcgtgagataggccagacccatcatcaccacctgccacaatttcagtgattttcgcagacgggttttgccgggttgcgcagcaatattcagtggtgaattaatagccataattgctgcctcccctgcgtaataaggtttgcggtcgtgtcgacctgaaatcaaacctgtttagcaagggaagcaaagggggcggagtccagtcagtagcaggaggggcgcatacgcagcctccctcgccatgcggggatttaatcatcggcatcatctcatttcctcgtcacagtcttaatcgttaacggaagcccgttgccgcccgcgctccataacgcgacatccgggaaatgtctggattaccagcaaatgtcaggcctggctccgctcaggccgatgaaacaaccccgcaaggggtattacgcgtttttcaacatccactcaatttctgtttctgtgatgaggcgctcaaactgcaacagctcatcatttttacaggcgtgatagacatggcagaagcgttcgcctaaatagcggcgcaggtgatcattctcgataaactcacccagggcatcgctctggcgaatcggaaagggtaagccttcctgttccagcccgttgccttcgacttcttcctgcaacggcagctcgttatcaaggccatgcaaaataccggcaaaaatcgctgccatcaccagatatgggttggcatcggcacccgccacgcgatattccacgcggtgattatgacggtcgccgcacggaatacgcagggcgacggtgcggttgttatggccccacgacgcctgcgtcggcacatacattcccggctggaagcggcgatacgagttcacgtttggtgccagcaacgccatcgacgacggcatcaggtcaatcatcccggcgagcatctttttcagcagcggcgaatcttcgccttccgcgtcagaaagcacgttctcgccacgattattttgcatactgatatggatatgcattccgctgcccgcgtgctcttcatacggcttcgccataaaagtggcgtgcatcttatgcttttctgccatcagacgcaccaggcgttttagtgccagcgcatcatcgcaggcttccagcacgttatcagtatggtaaaggttgatttcaaactgacccggcgaggcctcagcgaccgcgccatctgccggaatcagctgtaactgcgccagttcatcaatatcattgagcacgtcggcgaagtggttgaggttatcaacggagtaaacctggctttgtgtattgcggtcatcggtgccaggcgcgcagggcggttgcagatacccttcagcgtcgcgctggcgatccagtaaatagaactccagctctaccgctacgaccgggaacaatccgcgctggcgcagctgctgccacaggcggttaagaacgttccgcggctcaacgtcaaagggagcgccatcttcatcgaccatggtcaggagcatctgaccgataaactctggatcggcggcagaaggagttaaggaaccgagaacaggaacacaggtacgatccggctcgcccatttcctgacccagacctgcttcttctactacgttgcccagaatatccattgcaaataccgaggccgggaaataacaccctttctcgagcttcttcaggcttgaaacaggaatacgctttccacggaagcaaccatttaaatcggtaagtaaaacatcaacatattgcgtattcgggtagcgctccaggtagcgtttcacttcctgcgtaaaggcgctaccccgcctctcttctgactgctgaacaaagttctctacttcaacgatattggtttccatgattcttcgcctttggtttgttttccgctcgttatcaaagcgtaaaatataatgaccaccattcgaatctgtatgcaaactaaatgtttgtcaaatgttaaattgagtttgcaaaaatgaaaacccactgctagattgaaaaaatattgaacataaaggtcatttaaagcgcagtaatggcgataatttagtccactttgtgagattgagcatggaaaatataatgaacaatccggttatcggtgtcgtaatgtgcaggaacaggcttaagggtcatgcgacccagactctgcaagaaaagtacctgaatgccatcatccatgcaggcggcttgcctattgcgctaccacatgcgctggcggaaccgtcattacttgaacaacttttgccgaaactcgatggcatttatcttcctggtagtcccagcaatgtgcagccgcacctatatggtgaaaacggcgatgagcctgacgccgatcccgggcgtgatcttctgagcatggcgataattaatgccgcactcgaaaggcgcatccccattttcgccatctgccggggtttacaagaactggtggtggcaaccggtggttcgttgcatcgcaagctgtgcgaacagcctgaattgctggaacatcgggaagatcccgaactgccggtggaacagcaatatgcaccgtcgcatgaagttcaggttgaagaggggggattactgtctgcgttgttacctgaatgtagcaacttttgggtaaactctctacatggacaaggggcgaaggtcgttagcccacggttgcgtgttgaagctcgctcgccggatggcttagttgaggcggttagcgtcatcaatcatccttttgcgctgggcgtacagtggcacccggaatggaacagtagcgagtacgcgctttcgcgtatattgttcgagggctttatcaccgcttgtcagcaccatatcgctgaaaaacagcgactctgaccactacagtttaaggaaatgcaaatatgagtgatgagggactggcgccaggaaaacgcttgtcggaaatccgccagcagcaggggctttcacaacgtcgtgccgccgaactctccgggctgactcacagtgctatcagtacgatagaacaagataaagtcagccctgccatcagtacgctgcaaaagctgctgaaggtgtatggtctgtcactctcggaattcttttccgagccggaaaaacctgatgagccgcaggtcgtcattaatcaggacgacttaattgagatgggtagtcagggtgtgtcaatgaagctggttcataacggtaacccgaatcgcacgctggcgatgatctttgaaacgtaccagccgggcacaaccactggggaaagaattaagcatcagggtgaggaaataggcactgtactggaaggtgaaattgttctgacgattaatggtcaggattaccacctcgtcgcggggcaaagttatgccattaataccggcatcccgcacagtttcagtaatacgtcggcaggtatttgccgaattatcagcgcccatacgcccaccacgttttaatctttttgttctgtaagccgggtaagcgcaatgcgcccggcaatctatacacaaaatcattcaagttgcatcaaggcggcaagtgagcgaatcccgatgagcttactcaggtaagtgattcgggggagcgaacgcagccaaggcagaggcggcttgaaggatgaagtgtatataaagaatgtcgccagaaataaacgggcatacggcccggggatctctgcgccctgacgttcacaaactgcatatatctgatagacgtgaaacaggagtcataatgaattttcatcatctggcttactggcaggataaagcgttaagtctcgccattgaaaaccgcttatttattaacggtgaatatactgctgcggcggaaaatgaaacctttgaaaccgttgatccggtcacccaggcaccgctggcgaaaattgcccgcggcaagagcgtcgatatcgaccgtgcgatgagcgcagcacgcggcgtatttgaacgcggcgactggtcactctcttctccggctaaacgtaaagcggtactgaataaactcgccgatttaatggaagcccacgccgaagagctggcactgctggaaactctcgacaccggcaaaccgattcgtcacagtctgcgtgatgatattcccggcgcggcgcgcgccattcgctggtacgccgaagcgatcgacaaagtgtatggcgaagtggcgaccaccagtagccatgagctggcgatgatcgtgcgtgaaccggtcggcgtgattgccgccatcgtgccgtggaacttcccgctgttgctgacttgctggaaactcggcccggcgctggcggcgggaaacagcgtgattctaaaaccgtctgaaaaatcaccgctcagtgcgattcgtctcgcggggctggcgaaagaagcaggcttgccggatggtgtgttgaacgtggtgacgggttttggtcatgaagccgggcaggcgctgtcgcgtcataacgatatcgacgccattgcctttaccggttcaacccgtaccgggaaacagctgctgaaagatgcgggcgacagcaacatgaaacgcgtctggctggaagcgggcggcaaaagcgccaacatcgttttcgctgactgcccggatttgcaacaggcggcaagcgccaccgcagcaggcattttctacaaccagggacaggtgtgcatcgccggaacgcgcctgttgctggaagagagcatcgccgatgaattcttagccctgttaaaacagcaggcgcaaaactggcagccgggccatccacttgatcccgcaaccaccatgggcaccttaatcgactgcgcccacgccgactcggtccatagctttattcgggaaggcgaaagcaaagggcaactgttgttggatggccgtaacgccgggctggctgccgccatcggcccgaccatctttgtggatgtggacccgaatgcgtccttaagtcgcgaagagattttcggtccggtgctggtggtcacgcgtttcacatcagaagaacaggcgctacagcttgccaacgacagccagtacggccttggcgcggcggtatggacgcgcgacctctcccgcgcgcaccgcatgagccgacgcctgaaagccggttccgtcttcgtcaataactacaacgacggcgatatgaccgtgccgtttggcggctataagcagagcggcaacggtcgcgacaaatccctgcatgcccttgaaaaattcactgaactgaaaaccatctggataagcctggaggcctgaaatgaccgaacataccagcagttactacgccgccagtgcgaataaatatgcaccattcgacacgctgaatgagtcaatcacctgcgacgtttgcgtggttggcggcggctataccgggctctcctccgcgctgcatctggcggaagcgggctttgacgtagtggttctcgaagcctcacgcatcggctttggcgcaagcgggcgcaatggcggacagcttgtgaactcctacagccgcgacatcgacgtgatcgaaaaaagctacggcatggacaccgcccgtatgctcggcagcatgatgttcgaaggtggtgagatcatccgcgaacgtatcaaacgttatcagattgactgcgactaccgccccggcggcctgtttgtggcgatgaatgataaacagctcgccacacttgaagagcagaaagagaactgggaacgctacggcaataaacagctggaattgctggacgccaacgccattcgccgtgaagtagccagcgatcgctataccggtgcgctgctggatcacagcggtgggcatattcatccgctaaaccttgccattggcgaagcggacgccatccgcctcaacggcgggcgcgtgtatgaactttctgccgtgacgcagatccagcacaccacgccagccgttgtgcgaactgccaaaggtcaggtgacggcgaagtatgtgattgtcgccgggaatgcgtatctgggcgataaagtagagccggaactggcgaaacgcagcatgccgtgcggcacgcaggtgatcaccaccgaacggctgtcggaagatttagcccgttcgctgatcccgaaaaactactgtgtggaagactgtaactatctgcttgattactaccgtcttaccgccgacaaccgcctgctgtacggcggcggcgtggtctacggcgcgcgcgacccggatgacgttgagcgccttgtggtgccgaaactgctgaaaaccttcccgcagctgaagggcgtgaaaattgattaccgctggacgggcaacttcctgctgaccctgtcgcgtatgccgcagtttggtcgcctcgataccaacatctattacatgcagggctacagcggccacggcgtgacctgtactcatctagccggacgtttgattgccgaactgctgcgcggcgacgccgaacgtttcgatgccttcgccaatctgccgcattacccgttccccggcgggcgcacgctgcgtgtgccgtttaccgcgatgggcgcggcgtattacagcctgcgcgatcgtctgggcgtttaatttccgattaaccgtgaagagtcaaaaggtgtgaaacatgagcaacaatgaattccatcagcgtcgtctttctgccactccgcgcggggttggcgtgatgtgtaacttcttcgcccagtcggctgaaaacgccacgctgaaggatgttgagggcaacgagtacatcgatttcgccgcaggcattgcggtgctgaataccggacatcgccaccctgatctggtcgcggcggtggagcagcaactgcaacagtttacccacaccgcgtatcagattgtgccgtatgaaagctacgtcaccctggcggagaaaatcaacgcccttgccccggtgagcgggcaggccaaaaccgcgttcttcaccaccggtgcggaagcggtggaaaacgcggtgaaaattgctcgcgcccataccggacgccctggcgtgattgcgtttagcggcggctttcacggtcgtacgtatatgaccatggcgctgaccggaaaagttgcgccgtacaaaatcggcttcggcccgttccctggttcggtgtatcacgtaccttatccgtcagatttacacggcatttcaacacaggactccctcgacgccatcgaacgcttgtttaaatcagacatcgaagcgaagcaggtggcggcgattattttcgaaccggtgcagggcgagggcggtttcaacgttgcgccaaaagagctggttgccgctattcgccgcctgtgcgacgagcacggtattgtgatgattgctgatgaagtgcaaagcggctttgcgcgtaccggtaagctgtttgccatggatcattacgccgataagccggatttaatgacgatggcgaaaagcctcgcgggcgggatgccgctttcgggcgtggtcggtaacgcgaatattatggacgcacccgcgccgggcgggcttggcggcacctacgccggtaacccgctggcggtggctgccgcgcacgcggtgctcaacattatcgacaaagaatcactctgcgaacgcgcgaatcaactgggccagcgtctcaaaaacacgttgattgatgccaaagaaagcgttccggccattgctgcggtacgcggcctggggtcgatgattgcggtagagtttaacgatccgcaaacgggcgagccgtcagcggcgattgcacagaaaatccagcaacgcgcgctggcgcaggggctgctcctgctgacctgtggcgcatacggcaacgtgattcgcttcctgtatccgctgaccatcccggatgcgcaattcgatgcggcaatgaaaattttgcaggatgcgctgagcgattaatagcccaacgcaataatgtctgatgcgctgcgcttatcaggcctgcaaacgacgtattgattatgtatgccgaataaagcattcacgccgcatccggcaagttgtattgctcaacttcgctaaatctggtgctttttcaacaacgcgcggaactgatgataagttaaccccagtaattcagccgcgcgcttctggttatatttcccttgttgcaaactgagttgcagcaactctttttcctgctgcatctgaaactcacgtaaatccagcggcagtgttggaagcgaggtggtttctgaaacggcgatagcgtcttcaggcggacgccgtttaaagggatcaataatgatgtcatcaagcggataatcgctggtgccgtggcgatacactgaacgttccaccacgtttttcaattcacgaatatttcccggccaacgataattcagcaatgtttctctggcgcgctccgtaaaccccgggaacagaggcagcttgatttcccgacacatctggatggcaaagtattctgccatcaacattatgtcgctttcgcgctcgcgcagtggtggcagttgtacaacatcaaaagccagtcggtcgagcaggtcagcgcgaaaagtgccttcattgaccatcgccgggagatcggcattcgtcgcgcataccaaccgcacattcacctgcaatggttggctgccgccaacgcgctccagttcaccgtactcaatcacgcgcaataatttctcctgcaccatcatcggtgccgtagcgagttcatcaagaaatagcgtaccgccgtcggcacgttcaaatctccctggatgacgtttttgcgcaccggtaaacgcccccgcttcgtgaccaaacagttcggaatccagcagattttcatttaacgccgcgcagttaagggaaataaacggcccttgccaacgggaggagagataatgcaggcggctggcaatcagctctttaccggtgccgcgttcgccgatgatgagcaccggtttgtccagcggtgcgagatgcgaaacctgttccagcacttcgagaaagctgttcgcctcaccaagtaaattatctttgtattctgccatgatgaaattcgccacttgttagtgtaattcgctaactcatcctggcatgttgctgttgattcttcaatcagatctttataaatcaaaaagataaaaaattggcacgcaaattgtattaacagttcagcaggacaatcctgaacgcagaaatcaagaggacaacattatgggtattttttctcgctttgccgacatcgtgaatgccaacatcaacgctctgttagagaaagcggaagatccacagaaactggttcgtctgatgatccaggagatggaagatacactggttgaagtacgttctacttcggcgcgcgcgttggcagaaaagaaacagctgactcgccgtattgaacaagcgtcggcgcgtgaggttgaatggcaggaaaaagccgaactggcgctgctgaaagagagagaggatctggcacgtgcagcgttaattgaaaaacagaaactgaccgatctgattaagtccctggaacatgaagtgacgctggtggacgatacgctggcacgcatgaagaaagagattggcgagctggaaaacaaattgagcgaaacacgcgctcgccagcaggcattgatgttacgtcatcaggcggcaaactcgtcgcgcgatgtgcgtcgtcagctggacagtggcaaactggatgaagcaatggctcgtttcgaatctttcgaacgtcgtattgaccagatggaagcggaagcagaaagccacagcttcggtaaacaaaaatcgctggacgatcagtttgccgaactgaaagccgatgatgcaatcagcgaacaactggcacaattaaaagccaaaatgaagcaagacaatcaataataacatccaggcggcgtccgaacgcgccgccgctcatcgtctaaggagtacttatgagcgcgctatttctggctattccgttaaccatttttgtgctgtttgttttaccgatctggttatggctgcattacagcaatcgttctggtcgcagtgaattgtcgcaaagtgagcagcagcgattagcgcaactggctgatgaagcaaaacggatgcgcgaacgtattcaggcgctggaatctattcttgatgcagaacatccgaactggagggatcgctaatggcgggcattaatctcaataaaaaattatggcgtattccacagcagggcatggtccgcggcgtctgcgccgggattgccaactattttgatgtaccggtaaaactggtgcgtatcctggtggtgctgtcgattttcttcggtctggcgctgtttaccctggttgcttacatcattttgtcatttgcgcttgatccaatgccggacaacatggcctttggtgagcagctaccttccagcagcgaattgctggatgaagtcgaccgtgaactggcggcaagtgaaacgcgtttacgcgagatggaacgttatgtcacttccgatactttcacgttacgtagccgtttccgtcaactgtgaggaaagttatgaatactcgctggcaacaggccgggcaaaaggtaaagcctggtttcaaattagcaggcaagctggtacttcttaccgcactgcgctatggcccggcgggtgtggcgggctgggcgataaaatcagttgctcgccgaccgctgaaaatgttgctggctgtggcgctggaaccgctgttaagtcgggctgctaataaactggcacagcgttataaaaggtgaggggagtttcgcaaaaattgttaaatctcaggcgtataatggatggcaattttcatccatagaaggacgcttacatgtttaaaaaaggcttacttgctctggcactggtgttttcactgcccgttttcgccgctgaacactggatcgatgttcgtgttccagagcagtatcagcaagagcacgttcagggggccatcaatattcccctgaaggaagtgaaagagcgcattgccaccgccgttccggataaaaacgacaccgtgaaagtgtattgcaatgccggacgccagtcagggcaagcaaaagagatccttagcgagatgggatatacccacgttgagaacgccggtggcctgaaagacatcgcaatgccgaaggtcaaaggttaaaagaattcaccatgagcggcgcttatgcgccgtttttttttctgtcacaccttatttacatccccatagattatttgcgtcagctcacaaatacgctttttccctggtaaaaaatgatttcctgcgtgactaaaacccttgtgctcaattgacagtttattttctgcggagtagtctctcgtttcatgggaccgctaccacggaaaggcaacatgaaacagaaaattacggattacctggacgaaatctacggtggaacatttaccgcaactcatttacagaaacttgtaacgcgtcttgagagtgcgaaacgattaattacacagcgacgtaaaaaacactgggatgaaagtgatgtcgtgttaattacctatgccgatcaatttcacagcaatgatttaaaaccattacccacatttaatcagttttaccatcaatggctgcaaagcattttttcacatgttcatttgttgccgttttatccatggtcatctgatgatggcttttcggtaattgattatcatcaggtcgccagtgaagcgggggagtggcaggatattcagcaactcggtgaatgcagtcatttaatgtttgattttgtctgcaaccatatgtcggcaaaaagtgaatggtttaaaaactatttacaacagcatccaggttttgaagatttttttattgccgttgacccgcaaaccgatctcagcgccgtcactcgcccgcgtgcgttaccgttattaacgccattccagatgcgcgatcattcaacgcgccatttatggaccacctttagtgacgatcaaattgacctgaattaccgtagccctgaagtgttgctggcgatggtggatgttttactctgttaccttgcgaaaggtgctgagtatgtccgcctggatgccgttggctttatgtggaaagagccgggaacaagctgcatccatctggaaaaaacacatctgattatcaaactgttacggtcgattattgataacgttgcgccaggtacagtgatcattaccgagaccaatgttccgcataaagacaacattgcttactttggcgcaggcgatgacgaagcacatatggtgtaccagttctcgctgccgccactggtgctgcatgcggtgcaaaaacagaacgttgaggcgctttgtgcgtgggcgcaaaacctgacactaccttccagcaacaccacctggtttaacttcctcgcctctcacgatggcatcgggctaaacccgctacggggcttgttgcctgaaagcgaaatattagagctggtcgaggcgttacagcaggaaggtgcattagtaaactggaaaaataatcccgacggtacacgcagtccgtatgaaataaatgtgacctatatggatgcgttaagccgccgtgagagtagcgatgaagaacgttgcgccaggtttatccttgcccatgcgattttgttaagtttccccggtgtgccagcgatatatattcaaagtattcttggctcgcgtaatgattacgcaggtgtcgaaaaactcggatataaccgtgcgattaaccgtaaaaaatatcacagtaaagagataacccgagaactgaacgatgaagctacattaaggcatgcggtatatcatgagttgtcgcgtttaattacacttcgtcgcagccataacgagtttcatccggataataattttaccattgatacgattaattcatccgtaatgcgtattccaagaagtaacgctgatggtaattgtctgactggattgtttaatgtcagtaaaaatattcagcatgtaaatattactaatctgcatggtcgggatctgattagtgaagttgatatattgggtaatgaaataacgctgcgcccctggcaggttatgtggattaaataaaaaggaacatctcatgattaaatcaaaaatcgtgctgttatcagcactggtttcatgcgccctgatttcaggctgtaaagaagaaaataaaacgaatgtatccatcgaatttatgcattcttcggtggagcaggagcgccaggccgttatcagtaaattgattgcccgttttgaaaaagaaaaccctggcatcaccgttaagcaagtgcccgtggaagaagatgcctataacactaaagtcattactctttcacgtagcggttcgctgccggaagtgatcgaaaccagccatgactacgccaaagtgatggacaaagagcagcttatcgatcgcaaagcggttgccacagtcatcagcaacgttggtgaaggcgcgttttacgatggcgtactgcgtattgtgcgtaccgaagatggtagcgcatggaccggtgttcctgtcagcgcctggattggcggtatctggtatcgcaaagatgtgctggcaaaagcggggcttgaggagccgaaaaactggcaacagctgctggacgttgcacagaaactgaatgacccggcgaataaaaaatacggcattgcgctgcctacagcagaaagcgtgttgacggaacaatccttctcccagtttgcgttatccaaccaggctaacgtctttaacgccgaaggcaaaatcacccttgatacaccagagatgatgcaggcactgacctattaccgcgaccttactgccaacactatgccgggttctaacgacatcatggaagtgaaagacgcctttatgaacggcaccgcgccgatggcgatttactccacctatatccttccggctgtgattaaagaaggcgacccgaaaaacgtcggtttcgtggtgccaaccgagaaaaactctgcggtctacggcatgttgacctcgctgaccattaccgccgggcaaaagaccgaagagacggaagcagcagaaaaatttgtcacctttatggagcaggcagacaacattgccgactgggtgatgatgtcgccaggtgctgcgctgccggtgaataaagcggtggtgactaccgccacctggaaagacaacgacgttattaaggcgctgggtgaactaccgaatcagctaatcggtgaactgccaaatattcaggtttttggcgcagtaggggataaaaactttacccgcatgggtgatgtgacgggttctggcgtggtgagttcaatggtgcataacgtcaccgtgggtaaagccgatctctctactacgctgcaagcgagccagaaaaaactggatgaactgatcgaacagcactaaacccaggacaggaatccgcaatgaacaggcttttttcaggtcgttccgatatgccctttgcgctgctgcttctcgcgcccagcttattactgctgggcggtctggtggcgtggccgatggtgtcgaatatcgaaatcagttttttacgtctgccgctcaatcccaacatcgagtcaacgtttgttggggtgagcaactatgtgcgtatcctctccgatcccggcttctggcattcgctgtggatgacggtctggtataccgcgctggtggtggcgggcagcaccgtgctcgggctggcggtggcgatgtttttcaaccgcgagttccgcctgcgcaaaaccgcgcgttcgctggtgatcctctcctacgtaacgccgtccatttcgctggtgttcgcctggaaatacatgttcaacaacggctacggcattgttaactacctcggcgtcgatcttctgcatctctatgagcaggcaccgctgtggttcgataatccgggcagtagctttgtgctggtggtgctgttcgccatctggcgctacttcccgtatgcctttatctcgtttctggcgattttgcagaccatcgacaaatcgctgtacgaagcggcagagatggatggcgctaatgcctggcaacggtttcgtatcgtcacgctgcccgcaattatgccggtcctggcgacggtggtgacactgcgcaccatctggatgttctacatgttcgcggatgtttatttgctgacgaccaaggtcgatattctcggtgtatatctctacaaaaccgcctttgcctttaatgatttaggaaaagcggcggcgatctcggtggtgctcttcatcattattttcgctgtcattctgctgaccaggaaacgggtgaacctcaatggcaacaaataaacgcacactcagtcgcatcggtttttactgcgggctggcgctgtttctcatcatcacgctgtttccattttttgtgatgctgatgacctcgttcaagggcgcgaaagaggcgatctcactgcatcctacgctgctgccgcagcagtggacgctggagcattacgtcgacatttttaacccgatgattttcccgtttgtcgactacttccgtaacagtctggtggtgtctgtggtttcatccgtggtggcggtattcctcggcattcttggggcttacgcgctttcccgcctgcgctttaaaggtcggatgaccatcaacgccagcttttacacggtgtatatgttctctggcattttgctggtggtgccgcttttcaaaatcatcaccgcgcttggcatttacgacactgagatggcgctgatcatcaccatggtgacgcaaactctgcccaccgccgtgtttatgctgaaaagctacttcgacaccatccccgatgagatcgaagaagcggcgatgatggatggcctcaaccgtctgcaaattatcttccgcatcaccgtgccgttggcgatgtccgggctgatatccgtgttcgtctactgctttatggtggcgtggaacgactatctgtttgcgtcgattttcctctccagcgccagcaatttcaccttaccggtgggcctgaacgcgctgttcagtacgccagattacatctggggacggatgatggcggcctcactggtgaccgcattgccggtggtgattatgtatgcgctttcggaacgttttattaagagtggtttgaccgccggtggcgtgaagggctaaagcggccagtttctttacaaggagttttaaatgaaaaagttagtagccacagcaccgcgtgttgctgcgctggttgagtatgaagatcgggcgattttagctaatgaagtgaagatccgcgtgcgtttcggcgcaccgaaacacggaacggaagtggtcgacttccgcgccgccagcccgtttattgatgaagactttaacggcgaatggcagatgttcactccgcgtccggcagatgcgccgcgcggcattgagtttggcaaattccagcttggcaacatggtggttggcgacattatcgagtgcggcagcgacgttaccgactacgcggtgggcgacagcgtatgcggctacggcccgctctccgagacggtcatcattaacgcagtgaataactacaagctgcgcaaaatgccgcaaggcagctcctggaaaaacgccgtctgctacgacccggcgcagtttgccatgagcggcgtgcgcgatgccaacgtgcgcgtaggggattttgtggtggtggtagggcttggcgcaatcggtcaaattgccatccaactggctaaacgcgctggcgcttctgtggtgattggcgtcgatcctatcgcccatcgctgtgatattgcccgtcgccacggcgcggatttctgccttaaccccatcggcactgatgtaggtaaagagatcaaaacgctgaccggcaagcagggtgccgatgtgattatcgaaaccagcggctacgccgacgcgctgcaatcggcgctccgcggtctggcttatggcggcaccatctcctatgtcgcgtttgccaagccgtttgccgaaggttttaacctcggacgcgaagcgcatttcaataacgccaaaattgtcttctctcgcgcgtgcagcgaaccgaacccggattatccgcgctggagccgcaagcgtattgaagaaacctgttgggaactgctgatgaacggttatctcaattgcgaagatttaatcgacccggtggtgacctttgccaatagcccggaaagctatatgcagtatgtcgaccagcatccggaacagagcatcaaaatgggcgttacgttttaattcaaaggaatgaaaaaaatgaaaatcggcacacagaatcaggcgttctttccggaaaacattctggagaaatttcgttatatcaaagagatgggcttcgatggttttgagattgacggcaaactgctggttaacaacatcgaagaagtcaaagcggcgatcaaagaaaccggtttaccggtgaccaccgcctgcggtggctatgacggatggattggcgactttatcgaagagcgtcgtcttaatggcttaaagcagatcgagcgcattctcgaagcgctggcagaagtgggcggtaaaggcatcgtcgttccggctgcgtggggcatgtttaccttccgcttaccgccgatgacctcgccgcgtagcctggacggcgaccgcaaaatggtgagtgattccctgcgcgtactggaacaggtcgccgcgcgtaccggaaccgtggtgtatctcgaaccgttaaaccgctatcaggatcatatgatcaacaccctcgccgatgcccgccgttacatcgtcgaaaacgatcttaaacatgtacagattatcggcgatttctatcacatgaatatcgaagaagataacctggcgcaggcgctgcatgacaaccgcgacctgctcggtcatgtgcatattgcggataaccatcgctaccagccgggcagcggcaccctggatttccacgcgctgtttgaacagctgcgcgcggataactatcagggctatgtagtgtacgaagggcgtatccgggcggaagatcctgcccaggcgtaccgtgattcgttggcctggttgcgtacctgctaagaggtctttgtgaaaagtgcaatgacaagctctccgctgcgggtcgcgataataggcgcaggccaggtggcggataaggttcatgcttcgtactactgcacccgcaacgatctggaactggtggctgtctgtgacagccgcctttcccaggcgcaggcgctggcagaaaaatacgggaatgcatccgtgtgggacgatccgcaggccatgctgctggcggtgaaacctgatgtggttagcgtctgctcacctaaccgttttcattacgaacataccctgatggcactggaagcgggctgccatgtgatgtgcgaaaaaccgcccgccatgacgccagaacaggcgcgggaaatgtgcgataccgcgcgcaaactgggcaaggtgctggcctacgactttcaccatcgttttgcgctcgatacgcaacagctgcgtgaacaggtgaccaacggcgttttgggagagatttacgttaccaccgcccgcgccctgcgtcgctgcggcgttcccggctggggtgtctttaccaataaagaactgcagggtggtggcccgctgatcgacatcggcattcatatgctggatgctgcgatgtatgtgctgggctttccggcggtgaaaagcgtgaatgcgcatagctttcaaaagatcggcacgcaaaagagctgtggtcaatttggtgagtgggatccggcaacttacagcgtcgaagattcgctgtttggcaccattgaatttcataacggcggcattctgtggctggaaacgtcatttgcactcaacatccgcgaacagtcgattatgaacgtcagcttttgtggtgataaagctggtgcgacgctgtttccagcacatatctacaccgataacaacggtgaattaatgacgctgatgcaacgggaaatagcagacgacaaccgccatttgcgcagcatggaagcctttatcaatcacgtacagggcaagcccgtgatgatagccgacgccgagcaggggtacatcatccagcaactggtggcggcgttgtatcaatccgcagaaacagggacgcgtgtggaattatgaccaggccagtaacgttatcagaaccccatttcagccagcataccctgaacaagtatgcatcgctgatggcgcaggggaacggctatcttgggcttcgcgccagccatgaagaagattacacgcgccagacgcgagggatgtatctggcggggctgtatcatcgggcgggaaaaggtgaaatcaacgaactggtgaacctgcctgatgtcgtggggatggagattgccataaatggtgaggttttctcgttatcccacgaagcctggcagcgtgagcttgactttgccagtggcgaattacgccgcaatgttgtctggcgtaccagcaacggctcaggttacaccatcgccagccgtcgctttgtttcggcagaccaactgccgctcattgcgctggaaatcactattacgccactggacgccgacgcgtcagtgctgatttcaacaggcattgacgccacgcaaaccaatcacggtcgccaacatctcgacgaaacccaggtgcgggtgtttggtcagcatctgatgcaggggagctacaccacccaggatggacgcagtgatgtggccatcagctgttgctgtaaggtgagcggtgatgtgcagcaatgctataccgccaaagagcgccgtttactgcaacataccagtgcgcagcttcatgcaggcgagacaatgacgttgcaaaaactggtgtggatcgactggcgggatgacaggcaagctgctttagacgagtggggcagcgcgtcgcttcgccagcttgaaatgtgcgcgcagcagagttacgaccaacttcttgcagcatcaacagaaaactggcgtcaatggtggcagaaacgtcgtatcacggtaaatggcggcgaagcgcacgatcagcaagcgttagattatgcgctttatcatctgcgcatcatgacgcctgcccacgacgagcgcagcagcattgcggcaaaaggcttaaccggcgaaggctacaaaggccacgttttctgggatacagaagtatttttgttaccgtttcatctgtttagcgatccgacggttgcccgaagtttactgcgttatcgctggcacaacttgccaggcgcgcaggagaaagcgcgacgcaacggctggcagggcgcgctatttccgtgggaaagcgcgcgcagcggcgaagaagagacgccggaatttgccgccattaacattcgcaccgggctgcggcaaaaagtggcctcggcgcaggcggaacatcatctggtggccgatatcgcctgggcggttattcaatactggcagaccacgggggatgaaagtttcattgcgcatgaaggcatggcgctacttctggagacggcaaagttctggattagccgcgcggtgagagttaacgatcgtctggaaattcatgatgttattgggccagacgaatataccgaacatgtcaataataatgcatacaccagctatatggcccgctacaacgttcaacaggcgctgaatattgcccgccagttcggctgtagcgacgatgcgtttatccatcgcgccgaaatgttcctcaaagagctatggatgccagaaattcagcccgacggcgttttgccgcaggatgattcgtttatggctaagccggcgattaatctggcgaaatacaaagcggcggcggggaagcaaaccatactgctggattattcacgcgcagaagtgaacgagatgcagatcctcaaacaagctgatgtggtgatgctcaattacatgctgccggagcagttctcagcggcatcgtgtcttgccaatctgcaattttatgaaccgcgcactattcacgactcgtcattaagtaaagcaatccacggcattgttgccgcacgctgtggcctgctgacccaaagttatcagttctggcgcgaggggactgaaatcgatcttggtgctgatccgcatagttgtgatgatggtatccatgctgccgcaactggcgctatctggctgggggcgattcagggttttgccggggtgagcgtgcgtgacggtgaattgcatctcaatccggcgttacctgagcagtggcaacagttgtctttccctctgttctggcagggctgcgaattacaggtcactcttgacgcgcagcgtattgcgattcgaacttctgcgcccgtttcactgcgtttgaacggtcagcttataaccgtggctgaagaatctgttttctgtttgggtgattttattttgcccttcaatgggaccgctaccaaacatcaggaggatgaatgaaactgcaaggggtaattttcgatctggatggtgtaatcaccgataccgcgcatctgcatttccaggcgtggcagcagattgccgctgaaattggcatcagcattgatgcgcagtttaacgaatccctaaaagggatcagccgcgatgagtctctgcggcgcattctgcaacacgggggcaaagagggcgactttaactcgcaggagagggcgcaactggcgtatcgcaaaaatctgctctatgtccactcactacgcgagttgacggtcaacgctgttctacccggcattcgctctttgctggcagatctccgtgcacagcagatctcggttgggctggcttctgtctccctgaatgcgccgacgattttagcggcgctggagctgcgcgagtttttcaccttctgcgcggatgcttcccaacttaaaaactcgaaaccggacccggaaatctttctcgccgcctgtgcagggctgggcgtgccgccgcaggcatgtatcggcattgaagatgcgcaggcgggcattgacgccattaacgccagcggtatgcgctcggtggggatcggcgcgggcttaaccggggcgcaattactgttgccttcaacggaatcactcacctggccgcggttatcggccttctggcaaaacgtatagcaaaggaatcaacatggctcagctttcgttacaacatattcaaaaaatctacgataaccaggtgcatgtggtgaaggacttcaacctggaaattgccgataaagagttcatcgtgtttgtcggcccgtcgggctgcggtaagtcgaccaccctgcgcatgattgccgggcttgaggagatcagcggcggcgatctgttgatcgacggcaaacgaatgaatgacgttccagccaaagcacgcaatatagcgatggtgttccagaactacgcgttgtatccgcatatgacggtttacgacaacatggcgtttggtctgaagatgcaaaaaatcgccaaagaggtgattgatgagcgggtgaactgggcggcgcaaattctcggcctgcgtgagtacctgaaacgtaagccgggggcgctttccggcgggcaacgtcagcgagtggcgcttgggcgggcgattgtacgcgaagcgggcgtgtttttaatggatgaaccgctctctaaccttgatgccaagctgcgcgtgcaaatgcgcgcagagatcagcaagctgcatcagaaactgaacaccaccatgatctacgtgacccacgatcagaccgaagcgatgaccatggcgacgcggattgtgattatgaaagacgggattgttcagcaagtaggtgcgccgaaaaccgtttataaccaacccgcgaatatgtttgtttccggatttattggatcaccagcgatgaattttattcgcggcacgatcgatggcgataaattcgttacggaaacgcttaaattaaccattcccgaagagaaattagcggttctgaaaacacaggaaagtttgcataagcccatcgtgatgggaatacgaccggaagatattcatccggacgcgcaagaggaaaataacatttccgccaaaattagcgtggcagaattaaccggtgcggaatttatgctctacaccacggttgggggcacgagttagtggtccgtgctggtgcgttaaatgattatcatgcaggagaaaatatcactattcattttgatatgacgaaatgtcatttctttgatgcagaaacggaaatagcaattcgctaaatacagggggaaggcattcccccaggataatacaaggaacaataatgaaaaagttattaccctgtaccgcactggtgatgtgtgcgggaatggcctgcgcacaggccgaggaaaggaacgactggcactttaatatcggcgcgatgtacgaaatagaaaacgtcgagggttatggcgaagatatggatgggctggcggagccttcagtctattttaatgccgccaacgggccgtggagaattgctctggcctattatcaggaagggccggtagattatagcgcgggtaaacgtggaacgtggtttgatcgcccggagctggaggtgcattatcagttcctcgaaaacgatgatttcagtttcggcctgaccggcggtttccgtaattatggttatcactacgttgatgaaccgggtaaagacacggcgaatatgcagcgctggaaaatcgcgccagactgggatgtgaaactgactgacgatttacgtttcaacggttggttgtcgatgtataaatttgccaacgatctgaacactaccggttacgctgatacccgtgtcgaaacggaaacaggtctgcaatataccttcaacgaaacggttgccttgcgagtgaactattatctcgagcgcggcttcaatatggacgacagccgcaataacggtgagttttccacgcaagaaattcgcgcctatttgccgctgacgctcggcaaccactcggtgacgccgtatacgcgcattgggctggatcgctggagtaactgggactggcaggatgatattgaacgtgaaggccatgattttaaccgtgtaggtttattttacggttatgatttccagaacggactttccgtttcgctggaatacgcgtttgagtggcaggatcacgacgaaggcgacagtgataaattccattatgcaggtgtcggcgtaaattactcgttctgataatgggctaaattgccggatgcggcgcgagtactttatccgatctataaatgtaggccggataagatgcgctagcatcgcatctggcattcaggcaaggtagctggtatttatttcagcgtcatatgcgtggcaacggtaatattctgtggtgacggttttccagaaattaagcggaataataactcgcagctttgttgacctaactcctgcgtcggaacatcgatgccgcccggtgcaggcgttaaaataaatgacagcgtttcattgctataacccaccaccgctaactgctgcggaatagcaatatttttctctgctgccgcacgataaatgctcattaatttcaggctgtcagtggcaaacaccgcctcaggcaacggtgactggcttaataattgccgtgctgcttttaatgcagtttcatgggtataaccgccatcaacaatccattcatcacgcactgcaatattatgcgcagccaggctctgcttataaccattaacgcgatcaaccgaaacatggacatcaagcggagcatgcaggcaggcaatattttgatgcccactttcaattaatgcatcggtcaacgcaatgctgtcgccaaaattatcggtatcgacagaataaacatgggcatattgaccttcaactttgccaatcaccaccaccggaatatcatatttatcgagttgggcaaaaaatgactcatccgctggcgaactgagcataataatgcctttaatcattttctgcttaattttgctttcgcatttttgcagatcttctgccggattgtgcgacgtttgtaatatcacgtcgaaaccttcttcttcagctttggcggtgatggcatgcaaaacttcagagaaaaacggattacccgccgtagttttggtcgaacgggtagaaatcaccataatggcatcaaaacccgaagaggtcagcgcgcgggccagcttgtttggctgatactgtaattcttcaatggcccgtaacactttttcgcgcgcttccggggagatattagtttgcttattcagcacgcgtgatacggtggattttgatacgcctgcaaccctggcaatatcataaatagtaggggacataggtcaggaactccgtccgaacgtgaatgctgcacatcttatggagttcgccggtcgatgacaacacgggcagttgataatcaatggcctggcccccacattcatatccttacgaatgattttttttctggtcttcagagcagcacaggacagcaatgaagcgacttaaaaatgaactcaatgcgctggtgaatcggggtgtcgacagacatctgcgcctcgctgtaaccggacttagccgcagcggcaaaacagcgtttatcaccgcgatggttaatcagttgcttaatattcacgccggagcacgtttgccgctgttaagtgcggtgcgtgaagagcgcctgctgggcgtgaaacgcattccccagcgtgactttggcattccgcgcttcacctatgacgaagggctggcgcagttatatggcgatccacccgcctggccaacgccaacgcgcggcgtcagtgaaatccgcctggcgctacgttttaaatcgaatgattcgctgctacgccactttaaggatacctccacgctgtatctggaaattgtggattatcccggcgaatggttgctcgacctgccgatgctggcgcaggactatttaagctggtcgcgccagatgacgggcttactcaatggtcagcgcggagaatggtcggcgaaatggcgaatgatgagcgaagggctggacccgctagcgcctgccgacgaaaaccggctggcggacattgccgccgcgtggaccgattatctccaccactgtaaagagcaggggctgcactttattcagcctgggcgctttgtcttgccgggagatatggcaggtgcgcccgcgctgcaattcttcccgtggccggatgtcgatacctggggcgagtccaaactggcgcaggccgataagcataccaatgccggaatgctgcgcgagcgctttaattattactgcgagaaggtggtgaaggggttctataagaatcattttctgcgctttgaccgccagattgtgctggtggattgcctgcaacctctcaacagtgggccacaggcatttaatgatatgcgtctggcactgacgcagctgatgcaaagttttcactacgggcagcgtaccctgttccggcgtttgttttcgccggttatcgataagctattgtttgctgccactaaagcggaccatgtgaccatcgatcagcacgctaatatggtttcattactgcaacaactgattcaggatgcctggcaaaatgcggcgttcgaagggatcagcatggactgcctggggctggcgtcagttcaggcgaccaccagcggcattattgatgttaacggtgagaaaatcccggcgctgcgtggtaatcgacttagcgatggcgcaccgctcactgtttatcctggcgaagttcccgcacgtttgcctggtcaggcgttctgggataagcaaggcttccagtttgaggcatttcgtccgcaggtgatggatgtcgacaaaccactaccgcatattcgtcttgatgctgcgctggaatttttaataggagataaattgcgatgaccgaaccgttaaaaccacgtattgatttcgacggtcctctggaggtcgatcagaatcctaaattcagggcgcagcagacctttgacgaaaatcaggcgcaaaattttgccccggccacgctcgacgaagcgcaggaagaagaggggcaagtcgaagcggtaatggacgcagcgttacgtccgaaacgcagcctgtggcgcaaaatggtgatgggagggctggctctgtttggcgcaagcgttgtcgggcagggtgtacagtggacaatgaatgcctggcaaacccaggactgggtggcgctgggtggatgtgccgctggggcattgattatcggcgctggcgtaggttctgtggtaacagagtggcggcgcttatggcgcttgcgacagcgcgcccatgaacgcgacgaagcgcgtgatttattgcatagccacggcacgggcaaaggccgcgcattttgcgaaaaactggcgcagcaggcgggtattgatcagtcgcatccggcgctgcaacgctggtatgcctcaatccatgaaacgcaaaacgaccgtgaagtggtcagcctgtatgcgcatttggtccagccagttttagatgcccaggcgcggcgcgaaatcagccgttcggcggcggaatcaacgttgatgattgcggtcagcccgctggcgttggtcgatatggcgtttatcgcctggcgcaatctgcgtttaattaatcgcatcgccacgctgtatggcattgaactggggtattacagccgtttgcgtctgtttaagctggtattgctgaatatcgcttttgccggagccagcgaactggtgcgcgaagtggggatggactggatgtcgcaagatctcgctgctcgtttgtctacccgcgcagctcaggggattggtgcaggacttctgacggcacgactcgggattaaagctatggagctttgccgcccgctgccgtggattgacgatgacaaacctcgcctcggggatttccgtcgtcagcttatcggtcaggtgaaagaaacgctgcaaaaaggcaaaacgcccagcgaaaaataatgcaatatcgggtgctgaccggatatctttacgccgaagtgcccgtttttccgtctttgtgtcaatgattgttgacagaaaccttcctgctatccaaatagtgtcatatcatcatattaattgttcttttttcaggtgaaggttcccatgcgtctggaagtcttttgtgaagaccgactcggtctgacccgcgaattactcgatctactcgtgctaagaggcattgatttacgcggtattgagattgatcccattgggcgaatctacctcaattttgctgaactggagtttgagagtttcagcagtctgatggccgaaatacgccgtattgcgggtgttaccgatgtgcgtactgtcccgtggatgccttccgaacgtgagcatctggcgttgagcgcgttactggaggcgttgcctgaacctgtgctctctgtcgatatgaaaagcaaagtggatatggcgaacccggcgagctgtcagctttttgggcaaaaattggatcgcctgcgcaaccataccgccgcacaattgattaacggctttaattttttacgttggctggaaagcgaaccgcaagattcgcataacgagcatgtcgttattaatgggcagaatttcctgatggagattacgcctgtttatcttcaggatgaaaatgatcaacacgtcctgaccggtgcggtggtgatgttgcgatcaacgattcgtatgggccgccagttgcaaaatgtcgccgcccaggacgtcagcgccttcagtcaaattgtcgccgtcagcccgaaaatgaagcatgttgtcgaacaggcgcagaaactggcgatgctaagcgcgccgctgctgattacgggtgacacaggtacaggtaaagatctctttgcctacgcctgccatcaggcaagccccagagcgggcaaaccttacctggcgctgaactgtgcgtctataccggaagatgcggtcgagagtgaactgtttggtcatgctccggaagggaagaaaggattctttgagcaggcgaacggtggttcggtgctgttggatgaaataggggaaatgtcaccacggatgcaggcgaaattactgcgtttccttaatgatggcactttccgtcgggttggcgaagaccatgaggtgcatgtcgatgtgcgggtgatttgcgctacgcagaagaatctggtcgaactggtgcaaaaaggcatgttccgtgaagatctctattatcgtctgaacgtgttgacgctcaatctgccgccgctacgtgactgtccgcaggacatcatgccgttaactgagctgttcgtcgcccgctttgccgacgagcagggcgtgccgcgtccgaaactggccgctgacctgaatactgtacttacgcgttatgcgtggccgggaaatgtgcggcagttaaagaacgctatctatcgcgcactgacacaactggacggttatgagctgcgtccacaggatattttgttgccggattatgacgccgcaacggtagccgtgggcgaagatgcgatggaaggttcgctggacgaaatcaccagccgttttgaacgctcggtattaacccagctttatcgcaattatcccagcacgcgcaaactggcaaaacgtctcggcgtttcacataccgcgattgccaataagttgcgggaatatggtctgagtcagaagaagaacgaagagtaagcgcgaatatgcctgatggtgcaacaccatcaggcatattaaattatgctttcagtacagccagagctgcttcgtaatccggctcggtggtgatttcatccaccagctggctgaaaatcacattgtcattttcgtcaataaccacaacggcacgcgctgccagacctttcagtgggccatcagcaattgccacaccgtaagcttgcagaaattcagcgttacggaaagtggagagggtgataacgttgttcagaccttctgcgccgcagaaacgagactgggcgaacggcagatcggcagagatacacagcacaacggtgttgtcgatctcagttgccagttggttaaacttacgtactgatgcggcgcaaacaccggtatcaatactcgggaaaatgttcagcactttgcgtttacccgcaaactgaccgagggtgacgtcagacagatcttttgccacgagagtaaaagtctgcgctttgctacccgcctgcgggatggaattggcgactgtaaccgggttgccctggaaatgaacggtttgtgacatgattatctttcctgtttacatatagttaacgtcacacctagtttatgctaactgtcaataacacagcaaacgctatttgcgcttaatccgcagaccaccgcgacaacaaggagtaaagatgagaaccgttaaggtattcgaggaagcctggcccttacataccccgtttgtgattgcccggggaagtcgcagtgaagcgcgcgtggtggtggttgaactggaagaagagggtattaaaggcaccggcgaatgcacgccgtatccgcgttatggggaaagtgatgcctcggtaatggcgcaaattatgagcgtcgtgccgcaactagagaaagggctgacacgggaggagttgcaaaaaattctccctgccggcgcagcacgtaatgcgctggattgtgcattgtgggatctggccgcgcgaagacagcagcaatcgctggctgatttgatcggcataacgcttcccgagacagttatcactgcacagacggttgtcatcggtacgcctgatcagatggccaatagtgcatcaacactctggcaggcaggcgcgaaattactgaaagtgaagctggataaccatcttatcagtgagcggatggtggcaattcgcacagctgtgcccgatgcgacgctgatcgttgatgcaaatgaatcctggcgtgcagaagggttggcggcgcgttgccagctattggcggatttaggcgttgcgatgcttgaacaaccgcttcctgcgcaggacgatgcggcgctggagaattttattcatccgttgccgatttgtgctgatgaaagttgtcatactcgtagcaatttgaaggcgctgaaagggcgctatgagatggttaatattaagctcgataaaaccgggggtctgacggaagcgctggcgctggcgactgaagcgcgtgcacaaggtttcagtctgatgctgggctgcatgttgtgtacctctcgtgccattagcgccgctttaccgctggtgccgcaggtcagtttcgccgatcttgacggaccgacctggctggcggtagatgtggaaccggcgcttcagttcacgacgggcgaattgcatctttaggatgccagcgcagcaagtttgccatcgcaaagagatatttttcgctggcttcgtcggaggagatgggcggaaactctgcggtgatgcaatgcaagttcagatctgcacaccaactgccgaaagagccaggcgtttcataaccgacgctggttaccagaggcaattcaaacgcctgagccagccattcgcctaattcgctgtgtctgggatcttcaatacaggccagtggatcgtggaatgagaccacccaggcaggttgaatgcggtgtataagctggcacagcgcctgggtttcaggttcggagccaggtttgtcacctgtcagtaatacgacatcgcgttcttcagcggcgctgttccagcgataaacggtttcaccttccttccagttcgccgccggaaagtttctgtttaaatccacaccattagcattggcccgtaaccccaactggcagccgtcaggattcacacacagcaccacatgatgacggcgcaaagaaggtgtcaacgtccgcagagcacaggagagcgtgacgaccgaagagttttcatcaccgtgagtgccagccagaatcaaaccactttcgcggctggctgcaggggcaggaaaccagattaacggcgcgcccaataatgaacgtccgtaatgttctgttccgggcggaaatgcgccgcgttcggcgcgtgggcgggttacggtcatgatcgtctctggttcaggaagtattacaggcagtgttgtgcaaattttgcggattatcaaatccttttcttcaacgctatgtcatcgatcttgtatcacttttttgccggaagttgtttgcattttattagttggatagggtttgtggatttttgctggctgacgggcaaataaagtttgtttaatggtttgcttatctgccagttgattaatcacatggcgggctatctgaccgccagcaccaagaatcagtacatttttcatgaaaattatcccagattattggcagcaatatgccagtccatatcactattgcggatttgaatatgtttcattacagagtttcctcaaagaacggagctaatactgaaattgcttcagccacataggctttgccgtcataaagatccatatggtttgcgccttcaacaatgtgatagcgtttatcctggcttgatgctcgatcgtacaggtcgtcactcatccatttgctccctgcctggctgcccgccacaatctgcgtcggctgagtcaggtacacttccgccatatggtaagcatcataggtaataatctggttaaggctgcgcaaagtagcgtaacccggtgctgttggatactgcgcgcgaggggtgtggtaatactcccaggcctgacgcagttcttcgttcggcgcatcggactccttcattggtgccagtggcataatggcgtattctccgctgctaatatcgctggttctggcgtttgaacccgcttcaacgtatggcagggcatcaatagatttcacattgttttcccaaccattacggaatatcgaaccaatattgaccgcactaacggtaccgatggccttgatgcggcgatcctgaattgcagcattggctgtatatcctgcaccggcacaaattcccatcgcaccaattcgggtattgtcgacataagaaagcgttgtcaggtaatcaatcacggcactgatgtcttcagtacgaatgtatgggttttctaactgacgcggctcgccgccactttcaccttgataagatgcgtcataagcaatagtgacaaatcccttttccgccagttttttggcataggttccggccgtttgttctttaacgcccccacctgggtgagataacacaattgcctgatactgacgggtttcatcaaattttggagggaaatagatcactgcagacaaagagatggttggattattgctgttagtgaagctgactttattattcatcattccgttcctcatggagttgtcggttcgttttaacggttggtgatatcactatagatattgatcattaagttgattagacccaaaatcatgattagacctatcatttaaatgattaatagattgcatggagatactgaatgaagcgtgaagaaatcgctgatctgatggcgtttgtcgtcgttgcagaggagcgtagcttcactcgtgcagcagcccgcctgagcatggcgcagtcagctttaagccagatagtgcgtcgtatagaagaacgattgggattgcggcttctgacgcgaaccacgcgcagcgttgttccaactgaagcgggcgagcatcttttgtctgttcttggccctatgttgcatgacatagattcagccatggcatccctgagcgatctgcagaaccgcccatccgggacaatacgtattactactgtagaacatgcagcaaaaacgatattgttaccagcaatgcgcacattcctgaaatcgcatcctgaaattgatattcagctcaccattgattatggtttgaccgatgtcgtttctgaacgttttgatgcaggcgtccgtctgggtggggagatggataaagatatgatcgccattcgaatcgggccagatataccaatggctattgttggctcaccggattatttttctcgccgaagtgttccaacgtcagtgtcacaattaatagatcatcaggcaattaatttgtatcttcccacatcgggtacagcaaatcgctggagattaatacgcggtggacgtgaagttcgtgttcgcatggaaggtcagcttttactgaatacgatagacctgatcattgatgctgcaattgatgggcatggattggcgtatctaccttatgatcaggttgagcgggctattaaagaaaaaaaactgatacgtgttttggataaattcacaccagatttacccggttatcacctgtactatccacaccgtcgacatgctggctcggcattctcattatttatagataggctgaagtataaaggtgctgtttagcactacttgctgatacattaatttaattcttctcttaacgtattctcagttcctttcaacgttttggtcattttttattcttcgtacaatggcgacagatgctgattatgataccgaaaacgggtttgaacgtgcgaagcccgaacgtagtgttcggagttctatgtgctttaccgcattttggagactattatttacactaaatctgatttgatatattgatacttaaaacatttgatgcttcctttgtcacttttttgatggaagttgtttgcatttctttaaggcgaaacaaataattacgcatcaattttaatgtcggttagagggaaacttatgaagcactctgtttcagtcacgtgttgtgcgctgttggtcagcagcatttctctttcgtatgctgcagaagttccgagcggcacagtactggcagagaagcaggagctggtgcgccacattaaagatgagcctgcgtcgctggatcccgctaaagccgtgggcctgccagagattcaggtcattcgcgatctgtttgaaggtctggtgaatcagaacgaaaaaggggagattgtccccggcgttgcgactcagtggaaaagtaatgacaaccgtatctggacttttaccctgcgcgataacgcaaaatgggcggatggcacaccggtaacggcgcaagattttgtctacagctggcaacgtctggtggacccaaaaacattgtcgccatttgcatggtttgccgcgctggcgggaatcaacaacgcacaggcgattattgatggtaaagctacgcctgaccagcttggcgtcaccgcagttgatgcccatactttgaaaattcagcttgataaaccgttgccgtggtttgtgaatttaaccgctaactttgccttcttcccggtgcaaaaagccaacgtagaaagcggtaaagagtggacgaaacccggaaatctgatcggcaatggcgcttatgttcttaaagagcgcgtagtcaatgaaaaactggtcgtggtaccgaatacccattattgggataacgccaaaacggtactgcaaaaagtgaccttcctgccaattaatcaggaatccgcagccactaagcgttacctcgcgggggatattgatatcaccgaatccttcccgaaaaatatgtatcagaagctgttgaaggatattccggggcaggtttatacgccgccgcagctcgggacctattattatgcgtttaacacgcaaaaagggccgacggcagatcagcgcgttcgtctggcattaagtatgacgatagatcgccgcctgatgaccgaaaaagtattagggacgggcgaaaagccagcgtggcattttacaccagatgttaccgcgggatttacgccggaaccttcgccgtttgaacaaatgagtcaggaagaactgaatgcgcaggcaaaaactttgttgagcgcagctggttatggtccgcaaaaaccgctgaagctgacgcttttgtataacacttcagaaaaccatcaaaaaattgcgattgctgtagcatcgatgtggaaaaagaaccttggcgtagatgttaaattgcaaaatcaggaatggaaaacctatatcgatagccgtaacaccggcaattttgatgttatccgcgcctcgtgggtgggggattataatgaaccctccactttcctgacattattaacgtcaacgcattcaggaaatatttcacgctttaacaatccggcatatgacaaagttctggcccaggcatcgacggaaaataccgttaaagcgcgtaatgccgattacaacgcggcagaaaaaatcctcatggagcaagcaccgattgcaccaatttatcaatataccaatggacgattaatcaagccgtggctgaaaggttatcccattaataatcctgaagatgtggcgtacagtcggactatgtatattgtgaagcattgatgtgatgggaactggcgttacccttgtgcataacgccagtgatgtctgatttagcgaccctgttccggcggtgtaatgttatccatatacagcgtctggctggggaaggcaaagtccgcgccgtgtgactgtacaatatcgataatcttcaaataaacgtcttgctgtgcagcaagccattcagcccataccgtggttttggtaaagcaataaaccataatattcaatgaagagtcagcaaactggttgaaataaaccagtaaggtttgtcgctggtcgatggccgggtgatttttcagcatctcacgtacagcttcgacaataacgcccacttttgccgcatcctcataacgtaaaccaatggtcgtggtaatgcggcggttggtcattcgtcctgggttttctacgctgatcgacgaaaacagcgagttcggtacgtacaatggacgattatcaaaggtcgtaattttggtaattcgccagccaatttccgctactgtaccttcgatatttctgtccggtgaacggatccagtcgccaatactgaaaggacggtcgaaatagagcataatcccggaaaagaagttactcagaatatctttaccggccataccgacagccagaccaccaataccaccaaaggtcagcaagccagaaaggctcatgccgaaatgttcgccataaagcagaacaagcaccacaataatggtgattttgatgatacgcgacataatccgcgcactggtgatatcgcgaccttttttaatctgctgtttttcaaactgattaatcagcagaaatagcttaatcgtcagaataaccgcaatcagggacgtacagataaaatcgataacgcctggggtgataaatttgagtttatagttttctataacataattaataatgctaccaacagcactgataattatggtgtagattaaaaattgcaccgcatggaataaaaatccttttcttttacgatttccacggcgaaaccaaaagctcatcagaatcaatgctgcgcagctaccgaaaataatgaccagattaagcgcattatttgtaaacagttcagcgatcattgttttatcaggctcctccagataattgtcgtcatgccggaaacccctggcggggctattttaccgcgacaattcattcagatcatcaatagtcagggaaggaagtagcaacattagctaaggaaggtgcgaacaagtccctgatatgagatcatgtttgtcatctggagccatagaacagggttcatcatgagtcatcaacttaccttcgccgacagtgaattcagcagtaagcgccgtcagaccagaaaagagattttcttgtcccgcatggagcagattctgccatggcaaaacatggtggaagtcatcgagccgttttaccccaaggctggtaatggccggcgaccttatccgctggaaaccatgctacgcattcactgcatgcagcattggtacaacctgagcgatggcgcgatggaagatgctctgtacgaaatcgcctccatgcgtctgtttgcccggttatccctggatagcgccttgccggaccgcaccaccatcatgaatttccgccacctgctggagcagcatcaactggcccgccaattgttcaagaccatcaatcgctggctggccgaagcaggcgtcatgatgactcaaggcaccttggtcgatgccaccatcattgaggcacccagctcgaccaagaacaaagagcagcaacgcgatccggagatgcatcagaccaagaaaggcaatcagtggcactttggcatgaaggcccacattggtgtcgatgccaagagtggcctgacccacagcctggtcaccaccgcggccaacgagcatgacctcaatcagctgggtaatctgctgcatggagaggagcaatttgtctcagccgatgccggctaccaaggggcgccacagcgcgaggagctggccgaggtggatgtggactggctgatcgccgagcgccccggcaaggtaagaaccttgaaacagcatccacgcaagaacaaaacggccatcaacatcgaatacatgaaagccagcatccgggccagggtggagcacccatttcgcatcatcaagcgacagttcggcttcgtgaaagccagatacaaggggttgctgaaaaacgataaccaactggcgatgttattcacgctggccaacctgtttcgggcggaccaaatgatacgtcagtgggagagatctcactaaaaactggggataacgccttaaatggcgaagaaacggtctaaataggctgattcaaggcatttacgggagaaaaaatcggctcaaacatgaagaaatgaaatgactgagtcagccgagaagaatttccccgcttattcgcaccttccctaactaatcaatgcgttgattgtaaatccagctaagaggtgaggttttcagagcagacaacggtgaaatgtcatggtattgttacgtttaggtaacaagaaatttgtctgcacaaggattacatcatgattatggcgaaactgaagtcagcgaaagggaagaaatttctctttggtttgttggcggttttcattattgcggcgtcggttgtgactcgcgcgaccatcggcggcgttatagaacagtacaatattccgctgtctgagtggacgacatcaatgtatgtgattcagtcatcgatgatttttgtttatagcctggtctttactgtgttgctggcaatcccgttgggaatttatttccttggcggcgaagagcagtaagtaaaaaataggcccgataactcgggccttgtcagttattgaagagtcgttaatcgtcttcttcgtcatccagttcaacgggtgtctgatactggtcaggtttaatgaccagcaggtcgcagcgaagatgatcaatcacctgttccgccgtgttgccgaggaatgctgctgaaataccggtgcgtcctaccgtgcccagaaccacaatccccgcctgtaagtgctccgccaaatcaggaatcacctcttctggcagacctttttctacgtgcgtcatgttttcattaatgccgaatttctgccgcagggctttcattgccagcaaatgttgcccacgaatggcatcgttataaacgctcgggtcaaattccggcagttcaatcgcgatattaattggcgttaccggataagcgccaaccagatgaacttcggtatggttgacttgttctgccagttcgatcgtctctttgaccagtttttcattgagcgcattatgatacggctcttcactggcgagattcaccgccaccagcgccttgcctccttccggccacggctggtctttcaccatccacaccgggcttgggcatttgcgtaacagatgccagtccgttggcgtaaaaatcaccgcttccagacggtcatgttggtgcgccatttttagcaccaaatcgtgtccgccgctgatcacttcctgaatgatggcttcgaaaggacggttatgccagaccactttaatttcaatgggaacgccagcattgagataatattttgcctgctcgtggatccaggctgtacgctggctgatgacgccctgacgcatagcggtacgttcgtccggggagagcagggtggtcatttcgtatgagaagtcatagatcggcaaaaaggctttaattttgccaccaatccgttgatgtaaataaacagctcgccgcaatgctggttggtcgtcctggttaggatcgataacaacgagcatgttctgatacatagccatacagggtctccttacaacaactgtcaacgcagtttgtaattaaaagattaacccatatctggtgaatgaaacagtgatgaaccttctgccagatcaataaatcagaaaaatttaatgatatgacagaaggatagtgagttatgcggaaaaatcaggcaacgttacgcgtatgaccagcaagctgggccagcgcatcgttattttcgatggtgatgtatttacctttgactgccagcatgccgcttttctggaagcgacccagcagacggctgatggtttctaccgtcaggcccagatagttaccgatatcgccacgagtcatcgtcaggcggaattcacgaggggagaagccgcgttgggcaaaacgacgggacaggttgtagatgaatgcagccagacgttcctcggcatttttcttcgacaacagcaggatcatgtcctgatcgcctttgatttcaccgctcatcagacgcatcatctgctgacgcagattcggcattttaccggacaaatcgtccagcgtttcgaacgggatttcacataccatcgaggtttccagcgcctgcgcgaagctcgggtgatggccgctgccgatggcgtcaaatcccaccaggtcgcctgctaaatggaaaccagtgatttgctcgtcgccttgctcagtgatggtataacttttaatcgtaccggagcggatggcataaagcgatttaagttcatcaccagccttaaacagcgtctggcctttctgaataggcttcttccgctcaatgatattatcaagctgatcaagctcatgttcgttgagtgtgaacgggatgcaaagctggctgatgctgcaatcctggcaatggatagcacaaccgccagactgaatgcgccgtataattcgcttttccgggatcataggtctgctcaagccgtaattgatatttgtcaattttaacatctttttagggagcaagtaagtctaagcaaaccttaacagcagagaattccgatattagatgtaaatatatgtctatctatttgaaaacccttaagttgttaagggtaactttacataaaagtgtgaacaagctggcacaaattgtttaatgtttacagcaaaagataaccttcatggcgcaataaccactcttttcgctgaactccgcctgcatatccggtcatggtgccgtttcggccaataacccgatggcaaggtacgacgatgctgatgggattcgatccgtttgccgcaccaacggcacgcgccgcgccaggacggcccaattgctcagccagttggccgtaatgcattacctgcccgcaggggatagtgcgtagtgttttccagacttcgcgctgaaatggcgtcccccccgtagcagtgggaagcgtatcaataatgctaagattaccggcaaaatattcacgaagcttgtcgcttaaaccgcctggattggtggcagaaatgcgctcatagccttctttgcgataatggatgtccagcagctgcaccatgcgttcgctgtactcttcccattcaaccgcccgcaggcgaaattgctcatcgcaaatcacccacagtggacccagtggcgtggcaattttttcttcaagtaatctcagcatccgttctctcttaagacaaacgtgggtaaatacccggacctatcggcagaccgacaagataccacgccagcaacatcagcagccataccaccaaaaagataagtggatagggcaagactaacgaatagtaagtacccagtttcgcgtctggtttgtagcgttgcaggaatccaagaaacagtggaacaaaaggagataccggcgctaaaggcaatacggatgagtcggcaatacgaaagaggatttgcgcaaatgccgggtgaaagccaagtagcataaacattggtacgaaaatgggggcgagaatcgaccagattgcggaaccgctggcaataaacatgcataagaaagaggaaagcaacgccagaccgacaaacgccgggatgccgctaagccctgaactttccagtatatcggtcagccccacggcgatgaatttccccatgttgctccagttaaacatggcgacaaattgggcgaggggaaaaaccatcacgataaatcccgccatctctttcatcggttcaatcattaaatgcggtaaatccgcctgacgtcgaattgtgcgggtagcgatgccataagccagcgagacaacaaagaaaaaaagaatgatcagtggcacgatacctttaataaagggtgatggcatcacggtgtgattaatcggatcgcgcaatatcccgttttgcgggatcaccatcagcgcaatcgcagcaataaaaagtagcgatacgacacctgctatgcgtaaaccaaaacgctgactttcggtcaatgtctgcagtttctcatcgctgtttccctgccattgacctaaccgtggctcgatgattttgtcggttatcaggccgccaacaatcgtcagtacgactacggagctggccataaaataccagttatcaattacactgacgtgcatttgcggattgaacgcagctgccgcttccgtgctgatccccgacagcaacacgtcggttgtgacaatcagtaaattagccgtaaagccgcaacctacgcctgcaatggcagccagtaaacctgcaactggatgcctgcccaccgccagaaaaatcagcgcacccatcggtggcatgatcactaacgccgcatcggaagaaatgtggctgaaaaaagcaataaacagcaccatataactggcgtagcgggcattaacatgcgatgccattttaaccattagtgctggcagtaagccgacgcgctccgccagaccggcacctaaaaccagcgccaggatcgcaccaagtggagcaaaaccgctaaagtttttaataacattgggtaaaaaccagtgtaatccttccacactgagcaggtttttcaccacgaccggcgtaccatcggtcgggtttttcgcactgacgccaaaggccgacaaaattgccgtcgtcaccatgagtacgataatcaaatagataaagagcagaaaaggatggggaaccttgttaccaattctttcgacccagccatagagcttcccggattgggaggacgacggtatggatgacatactcatgggcattcctcggttgttgtgtttgcgttgttgttgttattttaaaggtgacggtgtcacgtttttcgggatagggcagtgatacggttgcgtgtccgttacttgctgatgctcttgttggcattcttgcaatagccctgaatcaaggaagagattgactgtggttgctgccatagttttcgccgccagcagcattcctttatgagcaatagatgttcgcccctggctaaccagttgccacgtatgtagcggtgtaccgacggcaaaacaggggctgaaacactgggcaacaggcagtttccaactgacgtcgccgacatcagtcgatgccgcaagcacgttatcggtggcggcatatggagcgacttcattcgccagtaccgtttcacgatgacgtagtgcaaaaaccttgccgttttcgccaccggttgcggcgatattattcagactgttttgccgatcgttggaggtgagcgtagcctgaatttgtttcgcaaaagccagttcttcggagttccattccggggtaccaaaatgggatagggcctggtacatggcattttctaaggtgcgattcgggagataactggaacaggctttgtcgaagcggcattcaaccgtggtttcggtcatcaatgccgcaccttcggcgattttggcgacccgatcataaatatgctgcacgtcggtcatttcgggggcgcggataagataaagcacttctgcctgcgcctggaccacgttgggcgagatcccgccgctatttgtgatggcatagtgtacgcgcgctttttcaataatatgttcgttgaggaagttggtgccagtggtcatcaacgttacggcatcaagggcgctgcgtcccaaatgaggggaattcgcggcatgtgctgcgatccctttaaagcgccatgatgcctgaatgtttgccagcgtgcgggtattgaacataccggcaaaggcttccgggtgccaggtgagtgccgcatccacatcatcaaataccccctcgcgaaccatgaacgttttacccgagccgccttcttcgccaggacaaccataaaagcgcaccgtgccgccttgcccatattgttccagccatttcttgacggctattgcagcggcaaaggcggcggttcccagcaaattgtgtccgcaaccgtgaccattttcaccgggcgtcacggatgtaggttgcgcgcaacctgcttgctgacttaaacctgccagggcgtcatattctcccagcagggcgataaccggtttgccttgaccaaacgaagcaataaaggcatttgggatattgcctacgttgcgggtaacggtgaagcctgcagattccagcgccgaagccagatgctccgctgaccagaactcttcaaaacgtgtttctggatgatcccagatttgatcggcaatatcggtataacgttggcgatcggcttcaatcgcatcgtcgataaaacgatagatttcctgcatcagatacctcgcgtccagggaaaattgagcgcggtgcgcgccagcgtttcgacggcaatagcgagaacctgctcgtcaaaatcgaatttttcgttgtgatgacctgccgccagctgtgtgccaaacaccacgtaggaggcttgcccttgatgttgctgcacgcgggccatcattaatgtggcatcttcggaacccgcaggcgcttcaacacgttcaatggcctgattgacccccgcgacctgagccgcctgactttgcaaccatgcgacccattgcggcgaaggagaactggcggtagctgcacccatcagacgagtttcaacgccgacaccatacatggttgctgcgccctgaatcgcttgttgtgcacggtcaaaaacatattgattaatgacgtcgctggccccgcgtgtttccactttcagcaacgccgaggcaggaacaacgttacgaccgcttcctgcctgcataacgcccacgtttactctggaagctccttcgctgtgcggggcgattgcatgcagtgcaagagtggcttgtgctgccgccaacaaggcattgtgaccgtcttctggttttgcgcctgcgtgagcggcggtaccggtgaagtgcgcgtcaaatttggtggttgccataaaattatcactgccgcacaccacggtgcccgcaggtacgccagtgccaatgtgcacggcagtaaaataatcaacatcatctacgacacctgcatcgaccatcgcccgcgcgccacgcgtaccttcctctgcaggctgaaaaatcagtttgatgacgccatgtagtccggactcgaactgtttaagggtatgcgccagcccaagcccaatggcggtatgtccatcatgaccacaggcatgcatcattccggcgttacatgacgcaaaaccgtcgcggtaggggcgatggctgacatcctgctcttcactgagatccagcgcgtccatatcgacacggaaagccatcaccggaccggggcgaccggtatccagggtggcgacgataccagtgaaaccaccttcaaaagccgcaatccattgtgctagcgcaccctgttgacgagcgcgctcgaattcgcgttgtagagtgaattcatcaggtaatcccatccggctactttcattaactacttcgcgacccagcgccagtgaatagccgagctggtgcaattcttccgcaacaagggtggcagtgcggaattccacccagccagactctgcatagtgatgaaaatcacgtcgccagtgcgataattttggggcaagcgaattaacaaattgattcaaagactccataacctttcccgtcatcagtaaaaagtgtgacccggttcacgtagcgatagtttttacttatcactaactgatttttcacagttttaaccgttcataaattaccctgacacaatcatctgcattaaagtagatgccagtttctttggtctgataaataacggttatcggtggcgtcatggcttttcaggtaaaaattcatcaaattcgggcttttgttgaagtggctcgtcagggcagcattcgcggagcgagccgaatgttgaatatgtcgcaaccggcactgagtaaatctattcaggagctagaagaagggttagcggcgcaactcttttttcgccgtagtaaaggcgtgacgttaactgatgccggtgaaagtttttatcagcacgccagtctaattcttgaagagctgcgcgcagcccaagaggatattcgccaacgacaagggcaactggcagggcagattaatatcggcatgggggccagtatttcccgcagtctgatgccagctgtcatatctcgttttcatcagcagcatccgcaggtaaaagtacgcattatggaagggcaactggtgtcgatgattaatgaattgcgtcagggagaattggatttcaccatcaatacctattatcagggaccgtacgaccacgaatttacttttgagaaattactggaaaagcaattcgcgatcttttgccgcccgggacaccccgccattggtgcccgttcgatcaaacagttactggattacagctggacaatgccgacgccacacggcagctactacaaacagttgagtgaattgcttgacgatcaggcgcaaacgccacaggtcggtgtagtctgcgagacgttctcagcctgtatcagtctggtggcaaaaagcgattttctcagcaaactgcctgaagaaatgggctgcgatcccttgcacggacaggggctggtgatgttgccggttagcgaaattttaccgaaagcggcctattatttgattcagcggcgtgatagtcgccagacaccactgaccgcgtcattaatcacgcaattccggcgagaatgcggctatctgcaaagttaaaactgcataaaaaaatagagtctgtcgacatccgccagactctacagtacacacagcagtgcatccgcgtcttaaatccggcattgtctcctctgcgccggtgactgtgttataacggttttaacctttagttgccaattttcttcagtgacagatttcacgaaaatataagttacattattaatatcgtgaatgaataatcatgcataagtattttgcttaaaatatcggcaatatttggaacttattactggaaatttgggtaatacgttgttggaccgacccggtctggttatcatatcgcgctcttaattgcgggaggatgtaacatgaaccttgacgacaaatcgctgtttcttgacgccatggaagatgtccagccgctgaaacgtgctaccgatgtccactggcatccaacgcgtaaccaacgtgcgccgcagcgtatcgacacgctgcagcttgataatttcctcaccaccggatttctcgacatcatcccactaagtcagccgctggagtttcggcgggaagggttgcaacatggggtgctggataagctgcgcagtggtaaatatccgcaacaggcgagcctgaatcttttgcgccagccggtggaagagtgccgcaaaatggtgttcagttttattcaacaagccctggcggatggtttgcgtaacgtgctgattattcatggtaaagggcgggatgataaatcgcatgccaatattgtccgcagctatgtggcgcgctggctgaccgaatttgatgatgttcaggcatattgcaccgcgctaccgcatcatggcggcagcggggcgtgttacgtcgcactacgtaaaacggcgcaggcgaagcaagaaaactgggagcgccacgctaagcgcagtcgttgatctcgagacgcatccgcggcttatgccgccagcacgcggttgcgtccatcatttttcgcccgatacaaagcatcatcaacgcgtttaaacagttcatcgatgctttcatttccttcgtgatgcgccacaccaatgctgacggtaaagcgtggtaagcccgaaatactcacttttgccacgcttacgcggatagtttcagccagcgaaagcgcggtatccagtggggttcttggtagcaataagacaaactcttcgcctccccaacgaaacaccaaatcgcctttgcgagcgcaactttcgagggtgcgggcgagggcgcataacacctcatcacctttagaatgcccatagagatcgttaatgtgtttaaaacgatcggtgtcgatgagcaacaagctgtaatcctgagcgatggcgagatgctgcatttggcctggttccgtaatgtgataaaactgtcgccgattcagtaatccggtcatcgcgtcatggtgagcagcatgttccagctgctcctccagccgtttttgctcagtaatatcatgcacaatacataacatgagcttgtcgccataaatttcaatcggtccggcataggtctgcacatgacgagtcgaaccatccgccagtttatgaacaaaattcaaaggtttatgaccaccgggtaaatgcgagatttcatgcatgataggcatgacgcgacgcccgagcatatttatttcccaggtatgtttctggcacatcgtttcatggttataaccatagaaattgagcgcggcgaggttagcatcgacgatttgtccatctcgtgacgggtcaatcaacaacattggtgcagagttagtcagaaaaaagcgcgcataaaaaccttgttttttgcgctgataatttgccgagcgactggcttttaaacccagcgttgccggcgcttcgataccttcgaaaataatcaccggttctgtttctgtcagctttcgcaaaacaagccgacagctcaatgctgtttcctcttctttacgctgaacagtgaggatttcgataatatcgtgttggttttgcagatcggagaggtatttcggcagttctttttgtgaggagacggaatagggtccggttcgtagctgactaaacgtgaggtcttgcatcaacagtttcgccgcgctattggcataaattaactgttcctcaaagggcgaaacgatccagacaggactggtgagtaagtccagggtattgaagttgtgcgtaatcattgagatcccgttatttttatcaatttttgttgctatccgatcgcaaaaaagccacgtcatatgatcagataattctgataatgatagacgctatttaacacttcacacggtttgtatacggaaaagcattttgctttttgtattcaatttagacagaattttattaatcatttcagggtaatggggtgatgagatgttgcgtaacagggccagaaggctagactacaaaataatgcgttgatgatggaggcactgtggaagcgattaagggatcggacgttaatgtcccggatgcagtatttgcctggatgctggatggtagaggcggcgttaaaccgctggaaaatacagatgtgattgatgaagcgcatccctgttggctccaccttaattatgtacaccatgatagcgcccaatggctggcgacaacaccgctgcttcccaataacgtacgtgatgcgctggcgggcgagagcacgcgtccccgagtcagccgtctcggtgaaggcacgctgattacattgcgctgtataaacggcagcaccgatgaacgccccgatcaactggtcgccatgcgtgtatatatggacgggcggttaattgtttcgacccgacaacgcaaagtgctggcgctggacgatgtggtgagcgatctggaagagggcacgggtccgaccgattgcgggggatggctggtggatgtgtgcgatgcgttgaccgatcattccagtgaatttatcgagcagctgcacgataaaattatcgaccttgaagataatctccttgatcagcaaattccaccgcgtggattcctggctctgctgcgcaaacaattaattgtgatgcgtcgctatatggcaccgcaacgtgatgtttatgctcgtcttgccagtgaacgtttgccgtggatgagcgatgaccaacgccgtcggatgcaggatattgccgatcgccttgggcgcggccttgacgaaatcgacgcctgtatagcacggactggcgtgatggcggatgaaatcgctcaggtgatgcaggaaaatttagctcgtcgtacctatacaatgtcgttgatggcaatggtctttttacccagtacctttctgaccgggttatttggcgtcaaccttggtgggatccctggcggcgggtggcaattcggattttcaattttttgtattctgttagttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttgcaggtgaatgcaacgtcaagcgatgggcgttgcgctccatattgtcttacttccttttttgaattactgcatagcacaattgattcgtacgacgccgactttgatgagtcggcttttttttgcctgttatttatcagcgtctaccctttaagagtccacccaatgaccagagggaaatatgacgacacttatttatttgcaaattcctgtccctgaaccgattcctggcgatcctgttccagtgcccgatccgatccctcgcccgcaacccatgcctgacccaccacccgatgaagaaccgattaaattgtcgcatcgtgagcgtagatctgcgaggatacgcgcctgctaactttgcgtcgatgaccacgagaatagattgtgaccgctttttctaccctgaatgttttgcctcccgcccaactcacgaaccttaatgagttgggttatttaaccatgacgccggtgcaggccgccgcgcttccggcgatccttgccggaaaagatgttcgcgtgcaggcgaaaaccggcagcggcaaaacggcggcttttggcctcggcttgttacagcaaattgatgcgtcgctatttcaaacccaggctttagtgctgtgtcctacgcgtgaactggcggatcaggtggcaggtgaattgcgtcggctggcgcgttttctgccaaataccaaaattttgacgttgtgcggtggtcaaccgttcggtatgcagcgtgattcgttgcaacatgcgccgcatattatcgtggcaacgccggggcgtttgctggatcacctgcaaaaaggcacggtatcactggatgcgttgaatacgctggtgatggatgaggccgaccgcatgctggatatgggatttagcgatgccattgatgatgtcatccgttttgcgcctgcatctcgacagacgcttctgttttcggcaacctggccggaagccatcgctgcaatcagcggacgagtgcaacgcgatcctttggcgattgaaattgactcaacagatgctttgccacccattgaacaacaattttatgagacatccagcaaaggcaaaattcctctgttgcaacggttattaagcttgcatcagccatcctcttgcgtggtgttttgcaataccaaaaaagattgccaggctgtctgcgacgcgctgaatgaagtagggcaaagtgcattgtcattacacggcgatttggagcaacgcgatcgcgatcagaccctggtacgttttgctaacggtagcgcccgtgtactggtcgcgactgatgttgctgcgcgtggtctggatattaaatcgcttgagctggtggtgaactttgagctggcgtgggaccctgaagttcatgtacatcgcatcggtcgtacagctcgtgcaggaaatagcggtctggcgatcagtttctgtgctccggaagaagcacagcgggccaatatcatttctgacatgttgcagataaaacttaactggcaaacgccgccagctaatagttccattgcgacgctggaagcagaaatggcaacgttgtgtatcgatggcgggaaaaaagccaaaatgcgcccgggtgatgtattaggtgcactgacaggagatatcgggcttgatggcgcagatattggcaaaatcgccgtgcatccggcgcatgtctatgtcgcggtccgtcaggctgttgctcataaagcatggaaacagttacagggcgggaagattaaaggaaaaacgtgccgggtgcggttattaaaataatgaaatgttgaattgccgggtgcaagagtaaacatcttattcgggattgccggatgcgacgctggccgcgtcttatccggcctccataagagtagcccgatacgcttgcgcatcgggcgctatcctggttatttcacttcaaccacattcagccgtaactcatccaactgattttcatcttcttctggctgccagcacgccggttgtagtgggatctcttcgcgatcaaacgccagatcacccccgttaaccacttcagaaccgtgggtgatgcctttgaaatcgaacaggttggtatcgcacagatgcgacggcaccacattctgcatcgcgctgaacatcgtctcgatacgccctggataacgtttatcccagtcacgcaacatgtcagcaatcacctgacgttgcaggttaggctgtgaaccgcacaggttgcacggaataatcgggaacgcttttgcatcggcaaatcgctgaatatctttctcgcggcagtaggccagcggacgaataacgatatgtttgccatcatcgctcatcagtttcggaggcatacctttcatcttaccgccgtagaacatatttaagaacaacgtttgcaggatatcgtcacgatggtgacccaacgcgatcttcgtcgcccccagttccgttgcggtacgataaaggataccgcgacgaaggcgagaacacagtgagcaagtggttttgccctctggaatcttctctttcacgataccgtaagtattctcttcaacaatcttgtactcaacgcccagcttttcaagatactcgggcagaacgtgttccgggaagcccggttgcttttgatcgaggttaacagccaccagcgaaaaattgattggcgcgctttgctgcaaattgcgcagaatctccagcatggtatagctgtctttacccccggagaggcaaaccatgatgcgatcgccttcttcaatcatattgaagtcagcaatggcttcgcccacgttacgacgcagacgtttttgtaatttgttcaggttgtattgttctttctttgtaatttgttgattttcttgcattatttcagttctctggtactaaatggggcaaattgggggcaaactttgcaactacgataaccgcgcattcaacatggctatctgttcgtcgttcatgtcatcaatccacataccgtaaatttcatacaccatctgcgcagtttcatgccccatttggctggctataaatgccgggttcgctcctgccgtcaacagccagcaggcaaaagtatgccgcgtatggtacggattacggcggcgaataccagcacgttttactgctgcattccaccttgcccccaaactgcttaccgagtaataaggtttttgttttccgttacacaccctgggcatgaaaacaaaatgcagtttttgcttttcggttctgccgtactcccgatgataaaaggtgatttcgcttttgcgatgatgcccggtcagtttgtattgctccttcagtgcttcaagagcaggctgcagtagtgttactgttcggatcccggcatttgtttttgggggaccgaacatatcaagtatcgtcaggtttcttctgacattcactattcccttttcgagatccacatcctcccacgccagagctgccagttccccgtgacgaagtcctgagtaaacggcaaatttccacaagttctggctctgtcctttttcactttccattaatgcattgaattctgttttagataacggatcaggctttattctgtttcgctgtaatttttttactccttcaaatggtttggttgatataaatcccgactgatacgcaaaacgcaacagcgaacagagcagggcgatatagttatcaactgtgcgcacggttcttccttttttgttggatcttggattatccaggtaaagcgtttctccatgcagcagttcattccggtagtttaagatatcgctataacgaatatgtgatatcggggtactttcacaaattattattctgagtgtttttaattgtgatttcgttttcttcattgtgtttgttgttaactctgtctctttaatttttgtccagatatcacaaagctctccgaacgtttttatgactctcgttgtcaccatttttgccccagtgctggactggggaaaacgtcttaaatactcaaattcaccggagtttatttcatgaactatcagcgctcttaaatttccggcctttttaatattactgtttgtaatctcccagccttttaatgtttcccgacatcgttttcctcgaaacatgaaccagatgcgaatgtatctacctctaatctcgacacctgttggtaatttagacatatcatgagtctttgataaactgatttatctttggatagttgtaccagataatccctcgtttgctgtctggcttacctaaaggagatactcgtttgaagtggaagccctccacccaacagttctggcggtatgcttcaatttgtctggcccccagaccagtgcgaagcatcaggccgtattcaaccatccactcttcattaaagattacttgtgccatcgcatcacctctggcaggcgccaatgttagactgaaattgacgcccgatgttgattattaataatcagctatgaagttttaatttgaatacaatgcaattctcgaggactgaagtttctcgcaattaaaatttatcagttttactttctgctctctggaaacgcctgcttcttttttacctgagagcattttttcgcattctgatttcgttagtttagattttgaatatcttgtccagttagtaggagtgccaccttccttttcaatagtggcggtaattttatacatgaacacctccattattatttccagtggttcgtttattccatctttcgagtgcttctttttcacttccaccataaccggttcgggattcgcatccgttacacttcgctcggtaatatcctgaaatggctttcaccgttactgatggacaaccacaaaatggacatggtttaacattgtcatatctcataatttttctcataaaaaatatttcaagttggcggtgcattacaccgccaggctgaattattcctctgaattatcgattacactgtattccccggttaatacagaggaatctgcaggatcgattgtcagtggttccttttcatccattgatactgcacgctggatctcaattgatacgggcaaatatttgaacaggcgacgaatagccgttttctttgccatttcttcccagtgagttacccacggcccgttattaccagctttactcaggctgcgcaccagctcaatctgtttgcgcgtcataacttcaaactgagtacctccgtctttcagtcttgcgacagcatagacgtgggtaaccggggcatcttcgttttctcccgggcggtgtattaacttttcatcaaggccaaattcgaagctaaactcgtcaccttcacggacaacacgggctgacaggctggcgatttgaccagaacggcgagccagatcaatcatgccgcgatagccaatgattagctgaacgttctttttaccgctcttttcgtttttattaccaaaaggcagtaaatatgcatgaccgagggcgctacctggctcaagtccgagctgtgaacactgtacgatcgcactgacaaaactcatagtgtcacagtttcctaacgccggaactttacgaatttctgtggtggcgatacggatcatacgttcagccgtcatatggcgtggaagagctgctgccagttgctctttcattgatggctggttaataaaactaatcacgtcgctatttttaactgctgctggtgcacggtttccctgagttttttgcagatcggcttttgcgattggtggttgcttagtcatttgcatattccttagcccagcggggcagtgataatgtcttaatagctggccattcatcggtattcaggcagtcagacagggttcgcagattgcggtgatattcctgttgacctgccagttttgcttcttcgcccatcatgaaaatttcaaccggataacgtccgcattcaatagttgtgctggcaaccagaaaaacgaaagttggctgcactccaaactgtgcttcataaccgtcactgtagaatgcatcctgaacgtgatagcggtagtcgtaataagcggttttgaatcgttgaatatccgccgtagttttcacgtccatgatccagtgaaattcagggataattttgtccggacggcaccgacacaaaattcctgtttcaggatcttcccagtaaattgatgattcagcgtgtccggcgctttcaacaagccattgccccagcggcaaagccataacgctttgatacatgagttcaattttccggccttcttccgcagtgataaccgtttttcctgtgcttgcgcattccatcagaaacgctttctcttcttcttttccggcgtttgtacggcggttaaattcaggtgctacgataaagcggttactgaattcttccggttcaagtacccggcagtggaaagcagttcctaaatcgagcgtttttgtctttgtggtgtccacgggggcatttttacgccacaaatatagtgccggagtatcagcaatgtcatcgagctgagacttactgataccgggacccgcgtggtaattctcattcgaaattccgtaataaatacctggctctatgtcttctacgattacgggatctgcgacttcgccagtttcatcactgcaatcgcgatgcggatcgctgccagcattctcattgtgcggatgttcagcgccttccatttcctccggatcattttccttagcttcaacctgactctcttcatcgaatgtttcctggtatgttgcgtcgcccatcaccgcaccacagtcagggcagttatccccgccagtctggccgcaggcattgcaggctatttccggttcctgttgcactactggctcaggttgattcatatctgggctggttttttccgtttctggctggttctggtacacacaatcgcgagtctggatcccctttacccatttcggatcgttcgggtcgctaattccgtcaacaaattcaccacgtgatgcagcaagcaatttatcgtcatcgacaggattttttgatggaatgtttttccgggcttcatggagttctgcccgcagttcctgatatttcgcatcaacagaatttacctgtgactgagcatccagcggctgcgtgtcctgatgatgttcagttgcgtccggttccattgtttcagcctctccctgttcaactgccgttgttccagatggttgcggtttttcttcatcatcctgttttccttcttctgttactcgctgcggcatcggggcagaggagcgaccgcaggcaatatccacgatttccggatcagggttggcatgatcggtttcagtcagtactttgttcagatattcagtgacgtgcgcggggatgacctcgatcccaattggtgcttcttttacggacgcaaccacgatggcgcgggaataatccagcccgccaggcatggtgatgaatttgtcgcggaaaacagaaaagggcggtttattttcagcgataatttcctcaatgcgtttagcgtgtgccggatgaaggttatagatgtccagatccattgaacgggccagtacgccagtggctacgtcgcgcgccagtgacgtcagatcgtgtacgaaaccttcgccgcgatcggtgaggtttccgccgccagcattagcaccggaagccgtgcgagtgatgtgtgaaacacgattacccttcatccactcttttgtcagcagtcctcgatcggtgtagtcagcgttcaggtatgcttcgaaaaaagcagttatcagtcccaggtttgaattaccaggattagggaaaactttgtcagtgtcacgaaccagtttgtggagttcgcgaatttccagcgggtcgagcaggctggttttgtgggaaacagccagggcagtaacagccggtagttcttcagcccgagcaatgtgtaatgcctggagtccgtcgcgtgaaacgtgcgttaccggtttttcgctgccgtgttgagcaagccaacgaatgggcagttcctggccagaaattgggagtagcatattctcctcaatctcagtcatgtcttcgccgttgacgttggtattgccttgatagtgagcgttgtctggtgctgctcccggttttagttcccatgtcatggagtctttgctgagttgatagcgttcactccaggtaaaatcgatctcaccttcagcgggcaggtcattaacgacaggaaaattcgtggcaacagctttaaaatagctgctcagttttttacctgacttaacgatcaggtagtccagagtggcacaggtcgattcaaaatcgttgcttgcccacaggacgacgtcaggttcaccggatgattttttcgctttccgtaacaggaagagtggttttgtgctcattgttttttaacctcaactcagattaaaattcgttttgttcagtgaatgatcttgccggatacacactgttcatagcctgcgccatacgcaggctatttctttcagatttcaccttttaatttcattgcaattagagttgccagaaattcggcttttttttctgcgggcagattctttccgatatgcaccaggcacatttttttgacaccttcatcaagtgtttttacgttgcctgatggaccatcgatatcaaccacagtgaatggggtttctttattttctgttttaattacgtagccaatgcgctttccttccagattcacctcgtgaacaatgtcatcggtagttacaacagtggcttcataattggtaatcatgtttttctccttaattaaggttgagcgaatacctgccatttctggcataaattcagtttcgaatagtcaattaattaaagttcatgtgccatctggtctttttcggcacaagcttcactgcaatattttctcggttcgtcttttgataaaatcccgtgcatgaagtgaagcattctttcaatagctttgctttcttcaacgtcttttttgcaaaggtggtaagcacattttattttcttagtcatcaccatgactccgcctttacaggtaaaccatcacgaccgaggaagactttaatcatgcggtcagtaatgaatgtttttgtggtcaggttacgaatatatagttttcgctttttaatattgtttgccgaggcaatatatgtccggccttcatgaagaacataatcgccaggagtcacacactgacgtggtatttcatcagttccgaagtgatgtgcaatcataattatctccatttttacaaatgaactttgttgatgcggtgtctggtgcctccaggtgactgcaaccagttaacaattacagtcggctttcccacccaaaccaataaggactaacatgacttttaactgtgccacgtgcgcttagccgcattcaccgcatcacaaaattcactttaaaaagggcggacatcagccgaacttcaagaaaaaaactgatgccgccaggactacacacagcaatgtcgttatttacaaccggaggcgcactcccaccatttaaatttaacagacaagaccgactctttatggatatcggaaatgcgccttcgtgttgtgcccggttttatttcaccacctccgggcttcggtggtctcggctatacccctacagcgagagcttgtgttaacatttcaatacccttacagttgagagttattgatatgttggatgtatttactccattgttgaaactttttgctaacgagccactcgaaagacttatgtatacgattatcatttttggtctcactctctggctgataccgaaagagtttactgtcgcattcaatgcttatactgaaataccttggctctttcagattatcgtttttgccttttctttcgtggtcgccatttccttctcaagattgcgagcacatattcaaaagcattattcattactaccagagcaacgagtattgcttcgtttatctgagaaagaaatcgctgtatttaaagatttccttaaaacaggaaatcttattatcacttctccttgccgtaacccggttatgaaaaaattagaacggaagggcatcattcaacatcagagtgatagcgcaaactgttcttattatctcgtcaccgaaaaatactcccattttatgaagttattctggaacagcaggagtagacgttttaatcgttagcttactgtgtgcttctccaaccatcggcgcgcaccagtttcggttttaaatgttttgcttttggtatacgtcatggcagtgaacgttccatcctggttggggaacacgccgcacaccagggattcgttgttgccgaggtcgattttttgcattttgcgaatctcacatcttgttgctacgtatagcgacttctgcctgccagagatcccagtcgttgctgcgtaaagcctgcacagcctggttgtaagtgataccgcaacaatccatcaaatactgaactacttcgtaatgcaccatcttatctctccccttaacgccgggtggcggaactaactgctgcactgcaaaatttgaatcccgccgtcatgttcatacgcctcgggctggctacttaaccccttaccactgcctggtaactcgaagtattgcccggcgttctgtggggcggggtgggtggtatgctggaactataggtaatgcctaattgattgtcaataggctatgcctaatgttttgagcgtaacctaataggtgatggcgacagcagaaagtgatgggggggttaaataacggaatccaggagttttccgtcagaccatataagtttaagttccagtttttgtgatgttctggcttttccgttcagattcaagagctttcagatacttacccactttcatttccatcgctgctatgtaggcgcgaacatcgtggtcaacccaatctggttctgtagcatttccagataacaggaaagctacaatcgctcttatttcatcagaggctgcttgataaaggttgtttatatctaaaagttcactttttgtatctgaattggtgggggttggtatggggtattcgttaagcccccaatgctctggaccaacaacatcagaaaagaaacgccataattctggaagtttatctttacttatagagcctttcttaatccagtcataaattgatggtggttggactttaaagtggcgtgcgacctccgcctttgatttgacggatcccgatgcgatttttttgttaatggcctgctctatcgctcggcctaagtctttaccactaagcattgcttaatattctcctatgcgcattacattaggcaatccctacccttactgcattaggcacagcctattgacaattgcgttaggcgtcgcctaatatttctgtgtgtttttggagttcattcgatgaaaaaagagaactattcattcaagcaagcttgtgctgttgtcggtgggcaatcagcaatggctaggcttttaggtgtatcacctccaagcgtaaatcaatggatcaaaggggtacgtcaattgcctgccgagagatgtccagcaattgaacgtgcaacaagaggtgaggttctgtgcgaagaacttcgtcctgatattgactggtcatatttacgacgttcggcatgttgttcgcagaatatgtcagtgaagcaactaaatgacagtaacaaatcctcatttgatcatacctgaaacatcaagaggcaaatgattcatgaaaatcaagcatgagcacatcgaatcagtgttgtttgccctagcagccgaaaaagggcaggcatgggtagccaatgcaattactgaagaatatctgcgccaggggggcggcgaattgcccctggttccaggcaaggactggaacaatcagcagaatatctatcaccgttggttgaaaggtgaaacgaaaacgcaaagagaaaaaattcagaagctgatcccagcaattctggcaatccttccgcgcgagctgcgtcaccgactctgcatcttcgataccctggaacgccgtgcattactggcggcgcaggaagcgttaagtacggcaattgatgcgcatgatgatgcagtccaagccgtttaccggaaagcgcatttcagcggcggcggttcttccgacgattctgtcattgttcattaagcaaaagtttccatgctgtttgtgcttattctaagccaccgggcagcatcatacggggcaattatggccgcattaccatacatgcaactgtacatagctgattacctggctgacaccatgcatttgtcagcagaggagcatggtgcgtatttgttgctgatgttcaattactggcaaacaggaaagccaatacctaaaaacaggctggcaaaaattgcccgtctgactaacgagcgatgggctgatgttgaaccatccttgcaggagtttttttgcgataacggcgaggaatgggtgcatcttcggattgaggaagatctggcatcagtcagggaaaaattaaccaaaaaatcagccgcaggaaaagcatctgttcaggccagaagaagcagaaaggaagcagatgttcaaacaaaacaagagagaaatttaacaggtgttcaaacagatgttgaagtggtgtttgaacatgatgtcaacacaaaggcaactaataaagatacagataaagatctaaaaacagatccccccctaaatcccccccgggggaatcgaggtgtcaaaaagtttgaccctctggatattactttgccgaactggatttctgtctcgctttggcgtgagtgggttgaatttcgccaggcattgcgaaaaccgattcgaacggagcagggcgctaacggggcgatacgggagctggaaaaattccgccagcagggtttttcacctgagcaggtgattcgacacagcatcgccaatgaataccagggcttgttcgcgccgaaaggtgttcgacctgagacgttactccgacaggttaacaccgtctcgttaccggatagtgcgatcccgccaggcttcagggggtaactgaccatgaaaaatattgcgacaggcgatgttcttgaacgtatccgcagactggccccgtcacatgtaaccgcgccattcaagacggtagcggagtggcgcgagtggcaactttccgaaggccagaaacgttgtgaggagatcaaccgtcagaatcgtcagttgcgggtggaaaaaattctgaatcgctctggcatccagccattgcaccgcaaatgctcgttttcgaattaccaggtgcagaacgaagggcagcgatacgcgttgagtcaggcgaaatccatcgctgatgaactgatgaccgggtgtacaaattttgcgttcagcggaaaacctggtaccgggaagaaccacttagcggcagctatcgggaatcgcctgctgaaagacggtcagacagtgattgtggttaccgtggctgatgttatgagtgccctgcacgccagctatgacgatgggcagtcaggcgaaaaatttttgcgggaactgtgcgaagtggatctgctggttcttgatgaaattggcattcagcgcgagacgaaaaacgagcaggtggtactgcaccagattgttgatcgccggacagcgtcgatgcgcagcgtggggatgctgacaaacctgaactatgaggccatgaaaacattgctcggcgagcggattatggatcgcatgaccatgaacggcgggcgatgggtgaattttaactgggagagctggcgtccgaatgtcgtccagccaggaattgcgaagtaatttttaccgggagaaaaatttaatggagactgtttttgacgcactgaaagcaatgggaaaagccacatccatagaacttgctgcgcgacttgatatcagtcgtgaagaagtgctgaacgaactatgggaactgaaaaaggctggttttgttgataaaagcgcgtacacctggcgtgtggctgataacaatgttcagcaggaacagccagcgcaggcagaactgccggaagaaatcaccacagcaacagtagcgaaaatctcagagtgcgatttaaccgcgacgattgaacaacgaggaccacaaacggctgatgagctggctacattgtttggtaccacatcacgcaaagtggcttcaacgctggcaatggcaatcagcaaaggtcgtctgattcgcgtaaatcagggcggtaaatttcgttactgcataccgggcgataatttaccagcagagccgaaagcagcatcggtatctccgctctggttatctgcatcgtcgtctgcctgtcatggggtgttaatcattaccgtgataacgccatcgcctacaaagaacagcgcgacaaaaatgccagagaactgaagctggcgaacgcggcaattactgagatgcagatgcgtcagcgtgatgttgctgcgctcgatgcaaaatacacgaaggagttagctgatgcgaaagctgaaaatgatgctctgcgtgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctccgggaacgactggtaatgatgcaggcccaacttgaaggtgctcagcaatacataaccgagcagtgtttaaagtaaaatcttaactacaatatgattcattttgatgattgtttcataaggaacagtgaagtaagatctaagaggagttaaattttatacagtataatcataatattgcagcaaggtggttataattgaaagaatatttagatatgaatacatctcatgtaagagttgttactcatatgtgtgggttcctggtttggctctatagtctttcaatgttgccaccaatggttgtagcattgttttataaagaaaaaagcctgtttgttttctttataactttcgttatatttttttgcattggtggcggagcgtggtatacaactaagaaatctggcattcaattacgtacccgtgatgggtttattataattgtaatgttttggattttgttttctgttattagtgcattccctttatggattgactcagaacttaatttaacgttcattgatgctctgtttgaaggggtttctggaataacaacaacaggagcaactgtaattgatgatgttagttcattacctcgggcatatttgtactatcggtcacagttaaattttataggtggtttaggagttattgttctggcggttgctgtattgccattattgggtattggtggtgcaaagctttatcagtcagaaatgccggggccatttaaggatgacaaactcactccccgcctggccgatacgtcacggacactgtggataacttattctttattaggtattgcttgtattgtctgttatagacttgcaggaatgcctttgtttgatgctatttgtcacgggatttccacagtttcgcttggtggtttctcaactcatagcgagagtatcggatattttaataactatttggttgagctggtggctggttctttttccctgctatcggctttcaacttcactctttggtatattgttattagcaggaaaacgataaaacctttaatcagagatattgaacttcgtttctttctgttaatagccttaggggtgatcattgttacctctttccaggtctggcatataggtatgtatgacttgcatggaagttttattcattcgttttttcttgccagctccatgctcactgataatggtttagctacgcaggattatgcaagttggcccacgcacacgatagtgtttttgctgttgtcaagtttctttgggggatgtataggttcaacttgtggtggaattaagtcacttcgatttcttatacttttcaaacaaagcaaacacgagataaatcagctttctcatcccagagcgttgttgagtgtaaatgtaggagggaagatagttacagatcgtgtaatgaggtctgtatggagtttcttttttctttatactctcttcacggtgttttttatactggtgttaaatggtatgggatatgattttcttacatcatttgcaacagtggctgcatgtattaataatatgggattaggttttggggctactgcatcgtcattcggagtgcttaatgacattgcaaaatgcttaatgtgcatagctatgattcttggtcgccttgaaatttatcctgttattatattgttttcaggttttttttggcgctcctaatatatggctgatttataattgtgagtttaatattatgttgactcactcattgatccaatacctaactttaccagcaacacctccgtccccagtagcactggctgctggggtgcgttttattcataaagcaaggctgtatgagcgagaaattaaagatagtctatcgcccattacaagaattgtcaccgtatgcgcacaacgccaggacgcacagtactgagcaggtggcacaactggtagaaagtattaagcaattcggctggactaatccggtgctgattgacgaaaagggcgaaattattgcgggtcacggtcgtgttatggcggctgaaatgctcaaaatggattctgttccggtcattgttctgtctggcctgacggatgagcagaagcagcgataacgatcagtatcgctcccgtaatgcattaatccgtcgccacattgagaaaatggatgccagtttgcacgtcggaacgaaggagtttgatatttcaaaggtttccgaggtggattctgttgatgatttactcattgataatgccgctcgttatctgctgaaagactggaaaggggttggtgaactggttaatggtgttgaggttgcactggaatatacggcagaacgagggatcgcgctgcttaagcagaatccagagttgtactggcagatccttgcagaagcagccagcatcgcccagggtaaagagcagcagaagcaggatacgataaaaaagccatagctgcccagcggtggttatcggagttcgggggagaaaggggggaaaaggcaagatggaagcgagaaaaactcaggttgccaccgataccggaaccagaaatagacccggtgcttaaggagttgttgtacgcctattcggtaatatcccgtgcccgacgttatgctggaatggctggggtgcctttgcctttatctctgacagagataaatgaatatttagccactcatccggtattgattgagcgcgatgaatttgaagcagtgatctttgcactggatgaccagtattttcaggagcagtgtgtgtagttgttaattacgtacactctgttacagagatgtgatggtgtctttaattaaatcgatgatgctcctggagaaaagcattgcgtggcctcgtaatcgctatatctactattatgtcgcctgaaacccacttcgcggtgggttttttgttgtcaggagttttaataaatggcagagcaaacctcgcgtctcgcaataattattgatagcactggagcgaaaaataatgctgacaatctgacctcctcattagtcaaaatgacgcaggctggggaaactgctgcaaatagcgcagggaaagtgactaaggcaacagaagatgagaagaacgcgctcgcaaaattaaaagcagctattgatccagttggtgccgcaattgatactgtcggtcgacgctattctgaattaaagaaatttttcgataaagggcttattgataaagaagaatatgaatttcttgtccgtaaacttaatgaaaccacagaggaattgagcggggttgcgcaagcgcagagagaagccgagaaggccggaaaacttgctgccgctcagcaggaagcgcaggctcaggcctttcaaagaatgctggacaagatcgaccctctggctgcggcgctaagaaatcttgaacaacagcatgatgaacttaatgctgcgtttgcatccgggaaaataaatggttctcagtttgagaattatagccgaaaaatacaggaaacacggcgagagcttaccggagaggctcaggcagagcgagaagcagcaaaagcgcatgatgaacaggttgttgctttgcaacgtctgattgctcaacttgatcctgtcggaactgcttttaatcgtctggtagaacaacagaaacagctcaatgaagcaaaagctaaggggatgctttctcctgaaatgtatgaggagctttctggaaaacttcgtgctatgcggagtgagcttgaggttactcaatcacaattaagcaaaaccggaatgtcggcaaaacaaacggcttttgctatgcgcatgttgcctgcacaaatgacggatattgttgttgggttgtccactggtcagtcgccatttatggtgttaatgcagcagggcggccattcagctatgcaggagacaagaatcgccagcttacccgttacagcgatacccgctggcatgaagattccgtgcgtaaccgctggttcagcgtgatggtggggccgtctgtgcgcgtgaatgaatggttcagcgcgtatgcgatggcgggtatggcttacagccgtgtgtcgactttctccggggattatctccgcgtaactgacaacaagggaaggtgcgaataagcaggtcatttcttcccaagctgactcgctgattaaaatttcgcggatctgggccgatttttttcccgcaaacacatcgaatcagcctatttaggctattttttccaccatttctggcgttatttccggtttttactgagatctctcccactgacgtatcatttggtccacccgaaacaggttggccagggtgaataacatcgccagttggttatcgtttttcagcagccccttgtatctggctttcacgaagccgaactgccgcttgatgatgcgaaacgggtgctccaccctggcacggatgctggctttcatgtattcgatgttgatggccgttttgttcttgcgcggattctgcttcaaggtttttaccttgccgggacgctcggcgatcagccagtccacatccacctcggccagctcctcgcgctgtggcgctccttggtagccggcatcggctgagacaaattgctcctctccatgaagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtagagctgggtgcctcaatgatggtggcatccaccaaagtgccttgggtcatcatgacgcctgcttcggccagccagcgattgatggtcttgaacaattgacgggccagttgatgctgctcgagcaggtggcggaaattcatgatggtggtgcgatccggcagggcgctatccagggataatcgggcaaacaggcgcatggaggcgatttcgtacagggcatcttccatggcaccgtcgctcaggttgtaccaatgctgcatgcagtgaatacgcagcatggtctccagcggatagggccgtcggccattgcccgccttgggataaaacggctcgatgacagcggtcatattctgccatggcagaatctgctccatgcgggagaggaaaatctcttttcgggtctgacggcgcttagtgctgaattcactatcggcgaaggtgagttgatggctcatgatgtccctctgggatgcgctccggatgaatatgatgatctcatatcaggaacttgttcgcaccttcccaaggggaaaacgcacgacgtgctgaccggaagtgatgacggtcgccacagcaacacgtctctggcgtggggagctggcgtgcagtttaacccgaccgaatccgtggccattgatattgcttatgaaggccccggcagtggcgactggcgcactgacggtttcatcgtgggtgtcggttataagttctgattagccaggtaacacagtgttatgacagcccgccggttcaggcgggcttttttgtggggtgaatatggcagtaaagatttcaggtgtactgaaagacggcacaggaaaaccggtacagaactgcacaatccagctgaaagcaaaacgtaacagcaccacggtggtggtgaacacgctggcctcagaaaatccggatgaagccgggcgttacagcatggacgttgagtacggtcagtacagcgttattctgttggtggaaggattcccgccgtcacatgccgggaccattaccgtgtatgaagattctcaacccggtacgctgaatgattttctcggtgccatgacggaggatgatgcccgtccggaggcactgcgccgttttgaactgatggtggaagaggtggcgcgtaacgcgtccgcggtggcacagaacacggcagccgcgaagaagtcagccagtgatgccagcacatcagcccgtgaggcggcaacccatgcggctgatgctgcggactcagcacgcgcagccagcacgtcagccggacaggccgcgtcgtcggctcagtcagcgtcttccagcgcaggaacggcatcaacaaaggccactgaagcatcaaaaagtgctgccgctgcagagtcctcaaaaagcgcggcggccaccagtgccggtgcggcgaaaacgtcagaaacgaatgcttcagcgtcactacaatcagcagccacatctgcatccaccgcgaccacgaaggcatcagaagctgcgacctcggcccgggatgcggcggcctcaaaagaagcggcaaaatcatcagaaacgaacgcatcatcaagcgccagtagtgcagcttcctcggcaacggcggcaggaaattccgcgaaggcggcaaaaacgtccgagacgaacgccaggtcttctgaaacggcagcgggacagagcgcctcggctgcggcaggctcaaaaacagcggctgcgtcgtctgccagtgcagcgtcaacaagtgccgggcaggcctcagccagtgccaccgccgccggaaaatcggcagaaagcgccgcatcgtctgcttcaacagccacaacgaaggctggcgaagccactgaacaggccagcgcagcagcgaggtctgcttccgcagcgaagacatccgaaacgaacgcgaaagcgtcggaaacaagcgcagaatcctcaaaaacggctgccgcatcgtcagccagttcggcggcgtcatcggcatcatcggcgtctgcttcaaaagatgaggcgaccagacaagcgtcagcagcgaagagcagcgccacgacggcatccacgaaggcgacagaggctgctggcagtgcgacggcggcagctcagagcaaaagtacggcggaatccgcggcaacgcgcgccgagacagcagctaaacgggcagaggatattgcatccgccgtggcgcttgaggatgcaagtacgacgaaaaaggggatagtacagctcagcagtgcgaccaacagtacgtctgaaacgctggcggcaacgccaaaggcagtaaaatcagcctatgacaatgcagagaaacgtctgcagaaagaccagaacggcgctgatatacccgataagggatgcttcctgaacaacattaacgcggtcagtaaaacagactttgctgataagcgtggtatgcgttatgtgcgggttaacgctcctgcaggtgcaacatctggaaaatattaccctgttgttgttatgcgttctgctggctcagtaagcgaactggcatcaagagtcattatcaccacggcaacgcgaaccgcaggcgatccgatgaataactgcgagtttaacggatttgttatgcctggtggctggactgacagggggcgttatgcttatggcatgttctggcaatatcaaaacaatgaacgagccattcactcaataatgatgagtaataagggcgatgatttgcgctctgtgttctatgttgatggcgctgctttccctgtttttgcgtttattgaagatggcctgtcaatatccgcacctggtgctgatctcgttgttaatgatacgacctataagtttggggcaacaaatccggcgactgaatgtatcgcggcggacgttatccttgattttaagagtgggcgtggtttttatgagtctcattcgttaatcgttaacgataacttgtcgtgcaaaaaactttttgccacagacgaaattgtagcgcgtggtggtaatcagattcgaatgataggtggggagtatggtgcattatggcgtaatgatggcgctaaaacttacctgctgcttaccaatcaaggtgatgtttatggtggctggaatacattaagaccgtttgctattgataacgcaaccggcgaactggttattggaaccaaactgtccgcaagtctgaacggtaatgcattaacagcaacaaagctgcaaacgccaagacgggtttctggtgttgagtttgatggttccaaagatattactttaaccgccgcgcatgtggctgcttttgccagaagggcaacggatacatatgccgatgcggatggtggcgttccatggaatgccgaatctggcgcttacaatgtcacccgctctggcgacagctatattctggttaacttctataccggagtcggaagttgccggaccctgcagatgaaggcgcattacagaaatggtggtctgttctaccgttcttcaagagacggttatggttttgaggaagactgggcagaagtttatacctcgaaaaatcttccaccagaaagctacccagtcggcgcaccaatcccgtggccatcagataccgttccgtctggttatgccctgatgcaggggcaggcttttgacaaatctgcttacccgaaacttgcagccgcttatccgtcaggcgtgatccctgatatgcgtggctggacgattaagggcaaacctgccagtggtcgggccgtattgtctcaggaacaggacggcattaaatcgcatacccacagcgccagcgcatccagtacagatttggggacgaaaaccacatcgtcgtttgattacggcactaaatccacgaataacaccggggcacatacacacagtgtgagcggctctacaaactcggctggagcacacacacactcactagccaacgtgaacacggctagtgctaactccggtgctggtagtgcatcaacaagattgtctgttgtgcataatcaaaactatgcaacatcatctgctggcgcacatacccactcactgtccggcactgctgcaagcgcaggtgcacacgcgcatactgtcggtattggtgctcatacgcactccgttgcgattggttcacatggacacaccatcaccgttaacgctgctggtaacgcggaaaacaccgtcaaaaacatcgcatttaactatattgtgaggcttgcataatggcattcagaatgagtgaacaaccacggaccataaaaatttataatctgctggccggaactaatgaatttattggtgaaggtgatgcatatattccgcctcatacaggtctgccagcaaacagtaccgatattgcaccgccagatattccggctggcttcgtggctgttttcaacagtgatgagtcatcgtggcatctcgttgaagatcatcggggtaaaacggtttatgacgtggcttccggcaacgcgttatttatttctgaactcggtccgttaccggaaaatgttacctggttatcgccggaaggggagtttcagaagtggaacggcacagcctgggtgaaggatacggaagcagaaaaactgttccggatccgggaggcggaagaaacaaaaaacaacctgatgcaggtagccagtgagcatattgcgccgcttcaggatgctgcagatctggaaattgcaacggaggaagaaatctcgttgctggaagcatggaaaaagtatcgggtattgctgaaccgtgttgatacgtcaactgcacaggatattgaatggccagcactgccgtagggtaaaacatataaattctataattagatgtatctttccatttacggcaaggaagggggcttggaagacgtaaagcatctcacaccgagattattttttatatgtcaggtgtctgaagttttgctttggctcttaaaatggtttgccgcgaggttttgaattcccgggcaatggcacttatacttacacctgacttaattcgttcgaataccacctgtttctgttcttcatttaacacaggaggtcgaccaaaacgtttccctgcgccgcgggctcttactatcccggaatgagtgcgttcaagtaaaaggtctcgttcaaattcagcgactgctgaaattacttgcatcatcatttttcctgttggactggtcaggtcaatgccacccaatgctaagcaatgcactctgatacctgtttcggtcagttgttccactgttttcctgatatccattgcattacaaccaaggcgatccagttttgtcacaatcaattgatcaccacatttcaggcgagcaagcaaccggttaaaaccaggacgctcactggttgctgctgagccgctaatgtgttcttcgattatttgctgaggtttgattttaaaacctgcactttcgatttcccggcgttgattttcggtggtctgatccagcgttgatatccgacagtaagcaaaaattcgagacatagtgagactctatacgaaattggtgttcatatcataatgcatctcagaaaataattatgattatttttgtgcatatttgtatgtacacgttcgaaaataaacgaatgcgtatgcaaccccgtaattttggtgagacccaaaatcgattttgtgaaaaatggctttaactcggtttgtttttcgagttccgggcggactcaaggaagaagaatagtgttgcgtgttattttaaccagatttcaagttgtttggtcgtggaaaagtggagcaaaatgttgttaaagtggaaaaatgataaaaaagtaagtttattatattacattttaccatttaaattttggttgtctttaagaactgatatcgctgtttgtaataattctttgttatccagccatgatgttttctttatgtttccttcaatgtaatcaagcaatgttctggtattgataggtcttccctgttttgctacttccactacagcatcccctaggataattcttacttcaggaagctgcgcagggaaccactttagggtgtcttttgatttcatgaagatattccttaaaatattattgattttcattgcgatattgtatgtctgattcaggatatgttgacttatacatcggttttgtctgggttattggatatgccaatccctaattttattagagcatgactaaaaatgctgaatatgataaggagcgaagtgattatcagtatgctgttcatatagcctcgaattagtaatgtgttatatatgatatagttgacaatttttatcctgggtgttcttaaagttcgtagataaacattgtcgtttcaggtatacaggaatgctaacaggtggcggcaaaaatcaggcggtttatggcgcaagctgaagtggcaactgcaaactatcttatgcagagactctacacggattgggtttaaaagtatacatagataacagtttttatctgaagaagaaaaatatcaaggtgatatagcctatatgcctttgatgcggaggaatgaatgtgatgggagtgatgtatctgaatagttgaaaaaccgcagtcacgtcgtatgcaagaacgtgctgcggttggtttgactttgattgagacgttttggaatttttttcggtggcaaaaatggggcaaaacgctgcaaaaggggcaaaaaaggggcaaaaaaagagtggattatcgtagcttattgttgtcgctgatgatatttaacacattgaaaaataagtaaaatacttatgagtcagagagttgtgatttttgcccttacttgttcaggttgtattgttctttcttactaatttcttgattttgcgacatttaaaagcgactcaattcgttatatggcatcagaagagtatgcgtcatgccggaacgcccagcataagaaatctgatataaaaaactgtggcgtgtatggtacggattagaggggaaaatgtcagcacatttgcgaaatgaatcaaaaagcccgcagcaatgtgcgggcgttagtgtcagcgcacaaccagcacggagcactctgcgtgacgcactacagctgcggcgttggaaccgagcagataagtggtgatatccggtcgatgggaagcaatgatgatcatatgagcggggatcttcttcgccaattccagaatgcggtctttgggcgagccttcctcaacatggacatgcactctgtcggttggcagtttaaattttttaatgatctcttccagttgcgatttggcttccgctttcaggtcatccattgccggtaattctgcggaatacgctaaacccagagaggcatagtagggcagtgaaggtattaccgtcaggaaatgaacctctgcatcatcaatctttgcctcttcctcaacgtggctaatcacgcgttgagttaattctgaatcggaaatatcgatagggacaagaatcgttctgttcataaaacctcctgttttagtatccgcataaagtgtaacgccagatgacactttttgtgtaatgacggagttcacatttttaatttagatcaaaggaggaagaataagcagaaaaagcccgccataacagcgggcaggaggatttagaactgataaaccagacctaaagcgacaatatcatcggtagagatgccattggcagcgtagaagctgtcatcttcatccaacaggttgattttatagtcaacgtaggtggacatgtttttattgaaatagtaagtcgcgccaatatcggcgtatttaaccagatctttatcatcaacacctgccgggttgtctgcaccacccgcagcgtgcaggtcacggcctttagacatcaggaaagagactgccggacgcagaccaaaatcaaactggtactgtgcagtgacttcaaaattctgggttttgtttgccacagcataatcgctgtcgccaaacggggtcatattacgcgtttctgaatacatggttgccaggtaaatattgttagcatcgtattttagcccagcagtccacgcgtctgctttatcaccacccgccgcagtatggttaacctggtcattggtgcggtcagaagaggtgtatgccgcaccagcgctaaagcccatgcctaaatcatatgttgtggaaagaccccagccgtcaccgttttcatggcgaacatcacgtccgttgttggtgccttcctgaccattactggctccttcgttgttaccttgatactgcaccgcgaagttcagaccatttaccagaccgaagaaatcagtattacgataagtcgcgacgccattggctcgaccagtcataaagttgtctgcattggtataagagtcaccgccaaattcaggcagcatatcggtccagccttcgatgtcgtacattacgccataattacgtccgtaatcgaaagaaccgtaatctgcaaatttcagcccggcaaatgccagacgggtccatgactggttttttgaagattcagtgttgtttgcctgaatattgtattcccattgaccgtagccagtgagttgatcgttaatttgggtttcgcctttaaaacccagacgcgcatagctctggtcgccatctttcgctgaattatcagaaaaataatgcaggccatcaactttgccatacagatctaatttgttgccgtctttattataaacttcggctgcatgtgcagcacctgcggcgagcagggcaggaattaaaagtgccagtactttgcttttcattgaataaatcctttagttattttatttgccttttatccccatttcggggagtgaaaacatcctaaaggagaagttcagttagccgataaatatcatttgttacgccttaagtaaaaccttaatcaaataattcctctgaaatgataataagtctggtgaatgtatcgaagataatacatacaaaataaaaattatacttttaatttgctatacgttattctgcgcgggttatatgcctttattgtcacagattttattttctgttgggccattgcattgccactgattttccaacatataaaaagacaagcccgaacagtcgtccgggctttttttttagaattggataatccttatccagagcatttaatcggtgttgcttttttccgcttttccggccatttgtgccaggaagtcatagcgtttttgcaaatcagctgcagcatctttccataactgttctgccacttctggctgctgcgaattcagccgacggaaacgttgctcgtgaagtaacgtttcttccggtgcttctgacggcgggcgtgaatccaaggccagcggcagtttgccttcatcggcacgacgcggatcaaagcgatatagcggccagaagccggtagctgtgagttggcgcatctggtcgtggctgagtgccagatcgtaaccatgctcttcacacgggctataagcaatgatcagcgatggccccggatacgcttccgcttcctgaatcgctttcaccgtctggttcagctgcgcgccgagagaaatctgcgccacataaacatgaccgtacatcatcatactgacgccaagatctttacgcgctttacgtttgccgtgctcgccaaatttagttactgcacccagcggtgtcgctttcgacgcctgaccaccggtgttggaatagcattgcgtatccagcaccagaatgttgacgttttccgtcaaactcaatacatgatccagaccgccaaagccgatatcgtaagcccagccatcaccaccaatcagccagattgatttttccaccagtgcatctgcatcacgtagcagttcatgtgcttcggcaacatcgttgagttgctggcgtaaagctgcaacctgttcacgacgaacctctggcgtggcgtctgatttcaacgccgtcagtaattccgccgggattttatcggcaaattgatccagcagacgcagcacgcggacacggtgttgatcgaccgtcaggcggaaaccaaggccaaattcggcattatcttcaaatagagagttcgcccatgccggcccacgaccgttggcatcggtggtatacggtgtagagggcaggttaccgccataaattgaagaacagccagtggcgttagcgatcaacatccggtcgccatagagctgagtcagtaatttaatatacggcgtctcgccacaaccggagcaagcacctgaatattcaaacagcggtgtaatcagctgcgatgtacgaatatcaatacgttccagtttgctacggtcgatttctggcaggttgaggaagaaatcgtaattgattttctcttcttcgacatgttccaggcgagacatcatattgatggctttaatctctggattctgacggtctttcgccgggcaaacttcgacgcacaggttacaaccggtgcaatcttccggtgccacctgcaagacatatttctgcccgcgcatatcacgcgatttcacatccagcgaatgcaggctggcaggggcgttttccatcgcttcaggcggcaccacttttgcgcgaatagctgagtgtgggcaagcggcaacgcagtggttacattgggtacagagttcctctttccagatggggatctcttcggcgatattgcgtttttcccagcgcgtagtgcccatcggccaggtgccgtctggcggcagcgccgaaacggggagggcgtcaccaagcccggcgagcatcgcagcggttacggttttcacgaaatcaggggcggcatcggaaaccactggcggtcgattggcgctgtgcggatttaccggttgcaacggaacttcttctacggattcacgcgccagcgccagagcctgccagttgcgttccaccagatcctggcctttgctactgtaacttttggcaatcgcaccctgcaattctgcgagggcgctatcgccaggcagaatttgcgtcagatggaaaaaagccatctgcatgacggtattaatacgggccgccaggccacattcgcgggcgattttcgccgcgttaatcacatagaagcgcgcttttttctggtttaacacggcctgaacttcttgcggcaagcgcgaccacacttcatctgcgctgtacggcgtgttgagcaggaaaatgccgccaggttttaaacgctcagccatctgatatttatcgataaactgcaactggtggcagccaacaaaatcagcctgggaaatgagataagcggaacgaatcggctgttcgctcactcgaaggtgagaaaccgtcaggccgcccgcctttttggagtcgtaaacaaaatagccctgtgcgtaccacggcgtggaattaccgataatcttgatattgtttttggtcgcggaaacgctgccatcactaccaaggccataaaacaaggcttccagtttcgccgagtttggcagggtgttttccggcaacggcagtgacagattggtcacatcatcgtaaataccaaccgtaaagcgcgctttcggtttagccgcgttgagctcggcaaataccgccagtacacagtctgggccaaattctttggatgaaagaccatagcgcccaccaatgacacggggcagagtttcgcgctcgccattattaaaggcttctgccagtgcggtcattacatccagatagagcggttctgcctgggcaccgggttctttggttctgtccagtaccgccacgctgcgtacggatcccggcagagcttgcagtaaatgtttagcggagaaggggcggtacaggcgaactttcagcacgccaactttttcgccacgggttagcaattcatcaaccacttcttcacaggtgccaatggcagagcccatcaggataatcacccgttccgcttgcggatgcccgtaatattcaaacggctgatactgacgacctgtcgcggcagagaaatcattcatcgcctgttcaacatggtcatagaccgcgttgtaccatgggttggtggcttcgcgagactggaaataagtgtcaggattggcggacgtaccgcggatcaccggatgttccgggttgagtgcccgggcgcgatgagcatcaatttcgacctgcggcatgagatcaagaatcgtgtcatcggccagcgggacaattttattgatttcgtgggacgtgcggaaaccatcaaagaaatgaataaatggcacgcggcttttcagcgtcgcgatttgcgaaatgagagcaaagtcttgcgcttcctggacgtttgctgcacacaacatcgcgcaacccgtctggcgcaccgccataacgtcggaatgatcgccaaaaatagagagtgcatgtgtggcaacggtacgtgccgctacatgcaggacaaacggtgttagttcgcctgccagtttgtacagcgtcgggatcatcagcagcaaaccctgcgatgacgtaaacgatgttgaaagggcacccgtctgcaaagcgccatgcacggtagcgatagcacccgcttccgactgcatttcaaccacgcgtggtgtgtctccccaaacgttctttaagccgtttccggcccaggcatcagcctgttctgccatcgtggaactgggggtaatagggtagatggcgataacttcactggtgcgaaatgcgaccgaagcaaccgcgccattaccgtcaatagtaatcatatgacacccttacattgcgcaaatgaggggcgcacgaaattgctgcgcgcccagtagtaatctttcaattttagcaaatggctttcttctgcattttcgcttttgtgtcccccacatcagcgtaatgaatgttttgatcaaacagagggcaaaaaaatagccataaaaaagtaaaaatgcggggcaacgcgcaggacagctctcgacgccgccctctgtgctgcctattatttatggcggtgtcgtttggcttgaagatcagaggaagaaaagatgcgagcagcgttttgggtagggtgtgccgctttattgttgtcggcgtgtagtagtgaacctgttcagcaggcgactgccgcgcacgtagcgccaggtttaaaagcgtcgatgtccagtagtggagaagcaaattgtgcaatgatcggcggttcgctttctgttgcccgtcaactggatggtacggcgattgggatgtgtgcattacccaacggcaaacgctgtagcgaacagtcacttgccgccgggagctgtggcagctattaattcattaaatccgccagcttataagttaatgtctgttttgcggtcgccagcgttaactggttcgcggtcagatccacttgtgcaccttctttcagcatttcgctaatggtgttatcgagttcattaagctgcgggttagcgcacatcatacgggtcattgccagccctttggctgtcagttcaccattagacagtttgccttcaccgctaaagcggttacacatgctgccggaaatcatcattttttcaccaaagctgatttctggcggatttttatcgctggtcacgggcttaccgtttacgctttccagcacaaagcgatgatgctgtagctgttctggcgtaacagcaattttgtcattacttacacatcccgccatcagcaggcttagcgcaacaaacgcggctactttcttcattgtggttctcaattacagtttctgactcaggactattttaagaatagaggatgaaaggtcattggggattatctgaatcagctcccctggaatgcaggggagcggcaagattaaaccagttcgttcgggcaggtttcgcctttttccagattgcttaagttttgcagcgtagtctgagaaatactggtcagagcttctgctgtcaggaatgcctggtgcccggtaaacagcacgttgtggcaggcagacaggcgacggaatacgtcatcctggatcacgtcgttggatttatcttcaaagaatagatcgcgttcgttctcatacacgtccatacccaacgaaccaattttctgatttttcagcgcttcaattgctgcctgagaatcaatcaatgcaccgcgactggtattgacgatcatcacgccatttttcatctgttcgaaggcggcttcgttcaacagatgatagttttccggtgtcagcgggcagtgcagagagataacgtctgattcagagaacagggttggcagatcgacatactccacaccgagttccagcgccgctgcacttggatacggatcgaacgccagcagacgcataccaaaacctttcagaatgcgcagcatcgccacaccgattttaccggtaccgataacgcctgccgttttgccatacatagtaaagccggtcagaccttccagagagaagttagcatcacgggtacgctgatacgcgcggtgaatacggcggttcagcgtcatcatcataccgatggcgtgttcagcaacggcctctggatcataggctggaacacggactactttcagccccagttcttttgccgcgtcaaggtcgacgttattgaaaccggcacagcgcagggcgatatatttaacgccgtgctttttcagctcttccagcaccgggcggctgccgtcatcgtttacgaaaatacataccgcttcgcagccattggcagttttagcggttttttccgtcagcagaaagtcaaaaaattccagctcaaagccaaaggactcgttcacctgttgcaggtacttcttgtcgtactgttttgtgctataaacggcgagtttcataagactttctccagtgatgttgaatcacatttaagctactaaaaatattttacaaaatttcaaatttaattgaaagctatggcgatattgaaaaattcatcaacaactatgcttagtgtaggcgcaaccttcaactgaacggttaaacatgccacaatacccgtattgaatgcttaatttttcgctaaatcaggatattaactacccatgctgggtaaatataaagccgttctcgcgctgttattactgattattcttgtgccgttgacgctgctgatgacgctcgggctgtgggttcccacgctggcgggcatctggctaccgctcgggacacgtattgcattagatgaaagcccacgcattacgcgtaaaggtttaatcattcccgatctccgttatctggtgggagattgtcagcttgcgcatatcaccaacgccagcctttcacatcccagccgctggttattgaacgtcggcacggtagaacttgattctgcttgtctggcgaaattgccgcagacggagcaatcgccagccgctccaaaaacactcgcgcagtggcaggccatgctgcctaacacctggatcaatatcgataaactgattttttctccctggcaggaatggcagggaaaactctctctcgcattaacctctgatatccagcaactgcgttatcagggcgaaaaagttaaatttcaaggccagctgaaagggcaacaacttacagtcagcgaactggatgtcgtcgcgtttgaaaatcagccgccggtaaaactggtgggggaatttgctatgccgctcgtgccggatggacttcctgtaagtgggcatgctactgcgacgttaaacttgccgcaggaaccgtcactggtggatgccgagctggactggcaggaaaatagcgggcaattgatcgtgctggcacgggataacggcgatccgttgctcgatttgccgtggcaaattactcgtcaacaattgaccgtaagcgatggtcgctggagctggccgtatgcaggttttcctttgagtggccgactgggtgtcaaagtcgacaactggcaggcagggcttgagaacgctctggtcagcggacgactgagtgtgctgacccaggggcaagcgggtaagggcaacgcggtgcttaattttggcccaggaaaattaagcatggataacagtcagctgcctctgcagctgaccggtgaagcgaaacaggcggacctcattttatatgcccgtttacctgcgcagctaagtggaagtctgtctgacccaacgctgacctttgagccaggcgcgttacttcgttcaaagggaagagtcatcgattcgctggacatcgatgaaatccgctggcctttagcgggtgtaaaagtcacccaacgtggtgttgacggacgtttgcaggccatcttgcaggcgcatgaaaatgaactgggcgatttcgtgctgcatatggatgggctggcgaatgattttctccctgacgctggccgctggcagtggcgctactggggaaaagggagttttacaccgatgaatgccacctgggatgtcgcaggaaaaggtgagtggcatgacagcacgattacgctgaccgatctctccaccggtttcgaccagttacaatacggtacgatgacggtagaaaagccgcgattaattctcgacaagcccatcgtctgggtacgtgacgcacagcatccctcctttagcggcgcgctgtcactggacgccgggcaaacgctgttcactggcggcagtgtgttaccgccatcaaccttaaaatttagcgtcgatgggcgcgatcctacctatttcctctttaaaggcgatttacatgctggtgagattggcccggttcgggtaaatggtcgctgggacggtattcgtctgcgcggtaacgcctggtggcctaaacaatcactgaccgtattccagccgctggtgccacccgactggaagatgaacttacgcgatggtgaactgtatgctcaggttgcattttctgctgcgcctgaacaaggattccgcgcgggaggacacggcgtgttgaaaggcggtagtgcctggatgccagataatcaggttaacggtgtcgattttgtcctgcctttccgttttgccgatggagcctggcatctggggactcgcggccccgttacgttgcgaattgccgaagtgattaatctggtgacagcgaaaaatattacggctgatttgcaagggcgttatccgtggactgaagaagaacccttgctgttgactgatgttagcgtcgatgtgttaggcggtaacgtactgatgaaacaattacgtatgccgcaacatgacccggcgctgttgcggctgaataatctctcatccagcgaactggttagcgccgtcaatccgaaacaattcgccatgtccggggcatttagtggtgcactgccgttatggctgaacaatgaaaaatggattgtgaaagatggctggctggcgaatagcgggccgatgacattgcgactggataaagacactgcggatgcggtggtaaaagacaatatgactgcgggttcagcaattaactggttgcgctatatggaaattagccgttcatcgacaaaaattaatttagataatctcggtttattaaccatgcaggccaacattacaggtaccagtcgcgttgatggtaaaagcggtacggtaaaccttaattaccatcatgaagagaatatttttacgctgtggcgcagtttacgctttggcgataatctccaggcatggctggagcagaacgcacgtctgccgggaaatgactgtccgcaaggaaaagagtgtgaggaaaaacaatgaaaattttactggctgcgttgacgtcatcttttatgctggttggctgtacgcctcgcattgaagtcgctgcacctaaggaaccgatcactatcaatatgaacgttaaaattgagcatgagatcatcatcaaggcagacaaagatgtcgaagagctgcttgaaactcgtagcgatcttttctgaggtgatgatgaagaaaacattacttctttgtgcgtttcttgttgggctggtaagcagcaatgtaatggcattgactctggatgaagccagaactcaggggcgggtaggtgaaacattttacggttatctggttgcgctgaaaacggatgctgaaacagagaaattagtagccgacattaatgccgaacgtaaagcgagttaccaacaactggcaaagcaaaataatgtgtcggtagatgatatcgcgaaactcgccgggcaaaagctcgtagctcgggccaaaccgggggaatatgtacaagggataaacggtaaatgggtgcgaaaattttaatagcaaaaccgcaatatcgggataacgctacaggagaaggcgattgatctattttcctgaaacaaggtgaatattcaaaaactcctgtcaaattgccttttgccctgaaaaatgcatagtcaaatatctgttttaactaattggcgttgcagtacatgcaacgccaattagttagcggaatttacgtcgatactcgcctggcgtcatcccaaagcgttgcttaaataccgttgaaaaatgactctggtcagaaaatccccaatgaaagccgatgcctgccagtttttcatcatctgcggcatggcgaatcgcatctgcacaaaaatcgagacgacggttacgaatatattgcgcgactaccaaacctttatcggcaaacattcggtacaaactacgtactgacatacctgtctctccggctatccactccgggcgtaatatctcttcgcgaatattatcgtctatcaacgtaaccactttttgaaactgacgttcacgacgaggttgaacagattcccgctgatgaagtaccgggcgcagcagacacaccatcgcctgtagcgcagcttcactttctgtttcagaaagtgccggattattcatgctctcctgtaacaggcgatgactgagttgcaccatgggtaagtcagcgtccagtctttctgcgcagataggtttttgatggggaaaatattgttccagcagagtgcgtggcaaaagtaatgaaatctgtttagaagactcctgccagtaaagcgaacaggggcgtgaggcatcgagtaacgtaatatcgccagcgccaatctgcacctgacgctcatcctgctccattattgcctgaccactaagctgaaaaacggtgtaaaaccaggcatcgtcgctgccttttacttcctgccaggtgcgggataaattcaccccgctggttgtcacggtactcagctttagtcctttggcaaaatgcgtgtccagtacacccgtgtaacgctcagtcagcaggcgtccggtaaaatttccgcatacctgattgatttgggaaagccattgctgaaactcattatccactgcggggttcatggcacgttttcgctctgtgaaatgtatttttattgttgcatttgtgttgcaataaacgaagctaatgagcctgactataggaaataagtcttgtcaggcatagagacataagcggttattgtcacgatttgcggagcttgtcacagctgacaaagcgaatgtcacagcgaaaaaagtgacttttcttgtcgctgcgtacactgaaatcacactgggtaaataataaggaaaagtgatgacagagccgcatgtagcagtattaagccaggtccaacagtttctcgatcgtcaacacggtctttatattgatggtcgtcctggccccgcacaaagtgaaaaacggttggcgatctttgatccggccaccgggcaagaaattgcgtctactgctgatgccaacgaagcggatgtagataacgcagtcatgtctgcctggcgggcctttgtctcgcgtcgctgggccgggcgattacccgcagagcgtgaacgtattctgctacgttttgctgatctggtggagcagcacagtgaggagctggcgcaactggaaaccctggagcaaggcaagtcaattgccatttcccgtgcttttgaagtgggctgtacgctgaactggatgcgttataccgccgggttaacgaccaaaatcgcgggtaaaacgctggacttgtcgattcccttaccccagggggcgcgttatcaggcctggacgcgtaaagagccggttggcgtagtggcgggaattgtgccatggaactttccgttgatgattggtatgtggaaggtgatgccagcactggcagcaggctgttcaatcgtgattaagccttcggaaaccacgccactgacgatgttgcgcgtggcggaactggccagcgaggctggtatccctgatggcgtttttaatgtcgtcaccgggtcaggtgctgtatgcggcgcggccctgacgtcacatcctcatgttgcgaaaatcagttttaccggttcaaccgcgacgggaaaaggtattgccagaactgctgctgatcacttaacgcgtgtaacgctggaactgggcggtaaaaacccggcaattgtattaaaagatgctgatccgcaatgggttattgaaggcttgatgaccggaagcttcctgaatcaagggcaagtatgcgccgccagttcgcgaatttatattgaagcgccgttgtttgacacgctggttagtggatttgagcaggcggtaaaatcgttgcaagtgggaccggggatgtcacctgttgcacagattaaccctttggtttctcgtgcgcactgcgacaaagtgtgttcattcctcgacgatgcgcaggcacagcaagcagagctgattcgcgggtcgaatggaccagccggagaggggtattatgttgcgccaacgctggtggtaaatcccgatgctaaattgcgcttaactcgtgaagaggtgtttggtccggtggtaaacctggtgcgagtagcggatggagaagaggcgttacaactggcaaacgacacggaatatggcttaactgccagtgtctggacgcaaaatctctcccaggctctggaatatagcgatcgcttacaggcagggacggtgtgggtaaacagccataccttaattgacgctaacttaccgtttggtgggatgaagcagtcaggaacgggccgtgattttggccccgactggctggacggttggtgtgaaactaagtcggtgtgtgtacggtattaatctggttcgctcataagtaaaaaacggcacctggtgccgtttttttgtctgaaacaatcacttatctttcttcagcgcccctagcgttggcgtttcgtcaaagaagttccatggtttcagcagagtatgtacccattcggtcggcataatcggccactcttcggcgcgggccacatgtgtggtgccggtggtcatccagacaacggcgtcggtgttgtccagcgactcgttatccttactgtattgtccaagaccggtgtcatgagtagaacggttcggatatttgccttccgggaaacgctcgccaggatgataacgcgttacccagagctgcttgtccataaagcttaaacgatgatagatccactcgtccggcgcgaactgggcaccttttgctaccgggtgagtaccacctgcataaggaataatttgataggaaaccggattgcccatgcggttctctttgttcgggttactcaacagacgaatcgtgcccggatcaaatttctgtgcggcatcctgttcattgccgatgttgtactgattaacttgcatggtactggtgcgtgggccaccggcagtattcggttttaccactgggtccatcgccaccaggctgttattctcgccatctacatccagatcgaggcggaaattataaatatgttggtgtgtagtacccacgatattgtgatcgataagcgtgccgtagcgcgtgtcatctttcgccgtctcatcgtgcatggttttcgctttaacacctttcaccgcttcgatgcccgtagcaccggcatcgatgccaatagtgccgttttcatggaagatccagtcaaaaatgtagtcatagttacccactgtactgatccagcgcaccactaactcccggcgttcggtactgacgttgggctggcccatttcctgatgcttatactccggcccggcataacgttcaaataccgcgatagcgcgagggatctccatcggcacgccagtgtagtcggcgatggtttcattaaggagcactgcgttagacggggcatctttaccacgagcaattggtgaggttagcgtgcccataccgtagtcaccagagtccagatacgctttaaagtaccagccaatatcaggatcaccgtaaggcacaatcatgccgccgagagaaccttcgtacatgactttgcgtttggtgccattgtcgttataagtcacggtggagatcatcggcccgacgcgagagttcatgctgaggtgaaaatcccagttccgccagtgaatcatatcgccagtaatggtgtaatttttaccttcaggctcaatgatttgcataggcttaactgccggagcaacgcggtcacggccatcaaatgggcgtgcggtcattggcaccggaactaccggaccttcttcaatcttaacgatttttttctgttctaaatcaacgaccgccaccaggttttcgatgggatgtgcccagtagttgccatcaccgacatcaagatagctgatgactttgagcaaccgggcatcttgtttcaggccatctttaccatcgaaataacctacggtcagcggcgtggtaatcacttttttcgcatcagtaataccgcgtttcttcacggcagcggcaaattcttcactgttgttaataatgttctgcacactggcgaaatcatccagcaacaccataccgtgggcgtctttaatgggttgccaggagagcagtttgttgttttgcagatccaccaccgcttcgatgatatgtttgccgtcgagcataatgacgtcggctttgcgcggctggtcaaccggtttgttttccagcgcaaacgcccagacagcttctttatctggcggtagcagggagatctcagtaaaacgggtattgggtttgaagtccgcggaagctttaacaatttcaacggcctgtttaatttcgtccgcagttagcgcattaagtgggtgagggcgcttttctacctgaaaggtttgatccagcccggactggaaaacatcgttaataaaggtgtcagaaacccaggctttattgtctttcatcactaccggtacttgcagtgccagaggctgaccattaacaattgctgtttgcgcaccaggcttcactttcacgtacgcgccatctttaatcagggtaaagagctgggcgtagtcgtcccactgcacatcggcaccaaattctttaagcgttttatccattggcaccatatgcgcttcaccaccgtgggcaaataccggcgcttgccaggcgaaacttaaggcgactgccaacgccagggttgttttacgggcagaatacagagaggggcttcccattattaacctcgtcagatgttgtgttcttgttagcaaccgcgctctgtgggcggtttagtcaggttcacattatcagtactgatgcaaaggggattgcctgcacctgccaggttgtttggcaggtgtgccagcttttcatacagtggatgccctgaaaatagatgtacacatcatgcataatgtgacaacgtcacaaaacttagtgaaataaaagggcaactattcgccgttgcccttcattcaccgattaatcgacaaaatcaccgtgctgcctggccaccagcgtcagaattgaatacagcgccaccggggtttgatgctgattgaatacctctacagcccattccaccacacctgttggtttttcttctgcgctacgctgttttttcagcgtcttgcgcttacaggtgagacgcacctggatggtatcgcctggctttacgggttcgataaaacgcaagctttccagcccgtagttagcaatgaccggaccgacaccggcatcgacaaacagacccgcagccgcagaaagcacaaaatacccatgcaccacccgctcaccgaaaatagattcggcagcagcaatcttatccatatgtgcatagaaatgatcgccgctgaggcaagcaaagttaacaatatcggcctctgtcattgtgcggcggggagtcaacaggctgtcgcctggttgtagctcctcaaaatatttgcggaacggatgaatacgatcttcttcgactttcgcaccgcgcacccactgtttactgatagcggcaagcatcgtcggactaccctgaacagcggttcgctgcatgtaatgtttcaccgctcgtaaaccgcctaattcttcaccgcctcctgcgcgaccaggcccaccatgtaccagttgtggcagtggggagccatgcccggtggattcttttgccgactcttcattgaggatctgaattcgcccatgcgtacgtgccgcgtcggcaataaactgacgcgcaatttgcggatcagccgtcaccagcgttcccgcaaggctaccgccgcctgcacaagccagttgcagagcatgtcgctggttttgtgctggcatcagcgttgcgacagggccaaaggcttctgttgcatgtaccgccggtgtttcatccggctgcggacagtacaataaggttggcgggaagaaggcacccgcagcagataaatccgcctgaccaccgaggcgaatctcgcatcctgcagccagcaatatgttcactttttcctgcacatcggcacgctgctcagcatttaccagtgcgcccattttcacgccttcctgagcaggatcaccgaccacgactttctgtaatcgcgcaaccagagcatcactgacagcattaaccaatgcctgcggcacaataatccgccggattgccgtacatttttgcccggcttttgtggtcatctcacgcacaacttcacgaataaacagcgcaaactccggttgatccggggtgacatcttcgcccagtacgcagcagttcagggaatcagcttccatagtgaaggggatagatttggcgacgatatttggctgaactcgcagcatctgtccggtcgccgctgaccccgtgaaagtcaccacatcctggctgtccagatgatccaacaagtcgccagcactaccgcagatcagactaattgcgccttcgggaacaagaccactatcgacaattgatttcaccatcgcctgagtcagttgggccgtcgcggtagctggtttgatgatggctggcattccgcccagccacgttggtgccagcttttccagcattccccagcaggggaagttaaaggcgttaatatgcactgccacgcctgactttgaggtcagtaaatggcgcgcggcaaatccaccttctttcgataaggggatcaattcatcttccggccacagcgtatcgtcaggcagctcccggctaccgaggctggcgtaagtaaataacgtcccaatgccaccttcaatatcaacccaactgtctgcccgcgttgcgcctgtttgcgcagaaagagcatagaaacgctctttttcactcagcagatgtttagcgaccgctttaagcatcgccgcacgttcgataaaggtcatagcgcgaagggcgggggcacctttttcaatggcaaactggcgggcagccgccatatcaagaccttcactggtcacttcccataacgcctcgccgctaatagcgtggtgaatcaaacggctacggccccggccagactgccaggtaccggataagaaactggctaactgctgcatcgctactctccagatgtttcacatttctgttgctaatagttaaatcgcgaatcataaaaagcaaaggatcttttaacgaaatgttaactatgcgatctgtatagcaactgcggaaaacattaatgcactgataaataatgatttataaaaatagggtgcgaaatccgtcacagttcaaacatacaaaatttgtgattttacttaactattgtgtaactttcataaaacaatgtgattcgtgtttttaattaattcacgaaaactggaatcgtaaaggtgatgacgtgacccaagaagaacgctttgagcaacggatagcccaggaaacggctatcgagccacaggactggatgcccgatgcttaccgaaagacattgatccgccagattgggcagcatgcgcactccgagattgttggtatgttgcctgaaggtaactggatcactcgcgcaccaaccttgcggcgtaaagccattctgttggccaaagtgcaggatgaagccggtcatggtctgtatctctatagcgccgccgaaacactgggctgcgccagagaagacatctaccaaaaaatgctcgacggacggatgaaatattcctccatctttaattatccgacattgagttgggctgatatcggtgttatcggctggctggtggatggcgcagcgatcgtcaatcaggtggcgttatgccgcacttcttatggcccgtatgccagagcaatggtgaaaatctgcaaagaagagagttttcaccagcgtcaggggtttgaagcctgcatggcactggcgcagggcagcgaagctcaaaagcagatgttgcaagacgccattaaccgtttctggtggccagccttaatgatgttcgggccaaacgatgataactcgccaaacagcgccagaagtctcacctggaaaatcaaacgtttcaccaacgacgaactccgccagcgtttcgtggataacaccgttccacaggttgaaatgctcggtatgaccgttcctgacccggatctgcattttgacactgaaagcggtcactaccgctttggtgagatcgactggcaggagtttaacgaagtaattaacggtcgcggaatttgtaatcaggagaggctcgacgccaaacgtaaagcctgggaagaaggtacctgggtacgggaagcagcgctggcccatgcacaaaaacaacatgcccgtaaggtcgcataaggagattcaaaatgagtaatgtttactggccgttatacgaagttttcgtgcgtggcaaacagggcttatcacaccgccatgttggcagtttacatgctgccgatgagcggatggcactggaaaatgcccgtgatgcttacacccgtcgtagcgaaggatgttcaatttgggtggtgaaggcgagtgaaattgttgcctcgcaaccggaagaacgcggtgaattttttgatccggctgaaagcaaggtctatcgccatccaacgttttacaccatccctgatggcattgagcacatgtgaggtcggaaatgaatcagttaacggcttacaccttgcgcctgggcgataactgcctggtgctctcccagcggttgggtgaatggtgcggtcacgcaccggaactggaaatcgatctcgcactggcaaacattggcctcgatttattaggtcaggcacgcaacttcttatcgtatgccgctgaattagcgggagaaggcgatgaagataccctggccttcacccgagacgagcgccagttcagcaacttattgttggttgaacaaccaaacggcaattttgccgacaccattgcacgccagtatttcatcgatgcatggcatgtggcgctctttacccgtctgatggaaagccgtgatccgcaactggcggcgatttctgccaaagcaattaaagaagcgcgctatcacctgcgttttagtcgtggctggctggagcgactgggcaatggtactgacgtatcagggcaaaagatgcagcaggccatcaacaagttgtggcgttttaccgccgaactgttcgatgccgacgagattgatattgcactgagtgaagagggtattgcggttgatccacgcactttacgcgcagcgtgggaagccgaagtttttgccgggatcaacgaagccacattgaacgtaccgcaagagcaggcgtatcgcactggcggtaaaaaaggactgcataccgaacaccttggacccatgctggcagaaatgcagtatctccagcgtgtcttgcccggtcagcaatggtaacagaggagatgggtatgcaacgtctggccaccattgcaccgccacaggttcatgagatatgggcgctactcagccagatcccggacccggagatcccggtgctgaccattactgatttaggcatggtgcgtaatgtgacacagatgggagaaggatgggtgatcggctttacgccgacatattccggttgtccggcaacggaacatttgattggcgcgatacgtgaggcaatgacaaccaacgggtttacccccgttcaggttgtgctgcaactcgacccggcatggaccaccgactggatgacccccgatgcccgtgagcgtctgcgagagtatggcattagcccgcccgccggacacagttgccatgcccatttgccgccagaagtacgttgcccgcgctgcgccagcgtccataccacacttatcagtgaatttggttccacggcctgcaaagcattgtaccgctgcgatagttgccgcgaacctttcgattatttcaaatgtatttgaggatgccatgacaacgtttcattccttaacagtggcaaaagtcgagtcggaaacccgtgatgcggtgaccattacctttgcggtgccccagcctttgcaggaggcgtatcgctttcgccccggtcaacatttgaccttaaaagccagctttgatggtgaagaattacgccgttgttactccatttgccgcagctatctgcctggcgaaattagtgtggcggtgaaagccattgaaggcggacgtttctcccgctatgcccgcgaacacatccgccagggtatgacgctggaggtcatggtgccgcaggggcatttcggctatcagccgcaggccgaacgccaggggcgctatctggcaattgcagcaggatcaggtattacgccaatgctggcgattatcgccaccactttacaaaccgagcctgaaagtcagttcaccctgatctacggtaaccgtaccagccagagcatgatgtttcgccaggcactggcagacctgaaagacaaatatcctcagcgtttacagttgttgtgcattttcagtcaggaaaccctcgacagcgatctgcttcacgggcgtattgacggtgaaaaattacagtcacttggggcctcgctcattaattttcgtctttatgatgaggcatttatttgtggtccggcggcgatgatggatgacgcggaaaccgccttaaaagcactgggaatgccagataaaaccattcatctggagcggtttaatacgcctggcacgcgcgtcaaacgtagcgttaacgtgcaaagtgacggacaaaaagtgactgtacgtcaggatgggcgggatcgggaaatcgtgcttaatgccgacgatgaaagcattctcgatgcggcattgcgccagggggcggatctgccctatgcctgcaaaggcggcgtctgtgcgacctgcaaatgcaaagtgctgcgtggcaaagtggcgatggaaaccaattacagtctggaaccggatgaactggccgcaggttatgtgttgagttgccaggcactgccgctgaccagcgatgtggtggttgactttgacgcgaaggggatggcatgagcgaactgatcgtcagccgtcagcaacgagtattgttgctgacccttaaccgtcccgccgcacgtaatgcgctaaataatgccctgctgatgcaactggtaaatgaactggaagctgcggctaccgataccagcatttcggtctgtgtgattaccggtaatgcacgcttttttgccgctggggccgatctcaacgaaatggcagaaaaagatctcgcggccaccttaaacgatacacgtccgcagctatgggcgcgattgcaggcctttaataaaccacttatcgcagccgtcaatggttacgcgcttggggcgggttgcgaactggcattgttgtgcgatgtggtggttgccggagagaacgcgcgttttgggttgccggaaatcactctcggcatcatgcctggcgcaggcggaacgcaacgtttaatccgtagtgtcggtaaatcgttagccagcaaaatggtgctgagcggagaaagtatcaccgctcagcaagcacagcaggccgggctggttagcgacgtcttccccagcgatttaaccctcgaatacgccttacagctggcatcgaaaatggcacgtcactcgccgctggccttacaagcggcaaagcaagcgctgcgccagtcgcaggaagtggctttgcaagccggacttgcccaggagcgacagttattcaccttgctggcggcaacagaagatcgtcatgaaggcatctccgctttcttacaaaaacgcacgcccgactttaaaggacgctaatgatggaattcatcctcagtcatgtagaaaagggcgtgatgacactaacgctcaaccgcccggaacgcctgaacagttttaatgatgagatgcacgcacaactggcagagtgcctgaaacaggtcgagcgcgacgacactatccgttgcctgttacttacaggtgccgggcgcggattttgtgctggtcaggatcttaacgatcgtaacgttgatcccacaggccccgcaccggatttagggatgtcagttgaacgtttctataacccactggtacgtcgcctggcaaaactgccaaaaccggtgatctgtgcagtcaatggcgtggcggcaggggcaggcgcaacactggcactggggggcgacatcgttattgctgcccgttcagcaaaattcgtcatggcgtttagtaagttaggcttaatacccgattgcggtggaacctggttactgccacgcgttgccggacgagcgcgcgccatggggctggcactgctggggaatcaactgagtgctgaacaggcgcacgaatgggggatgatctggcaggttgttgatgatgaaacgctggcagataccgcgcaacagctggcacggcatctggcgacacaaccgacatttggtcttggacttatcaagcaagcgataaatagcgctgaaaccaatacgctcgatacgcaactggatctggaacgtgactatcagcgacttgccggacggagcgcagattatcgtgaaggtgtcagtgcgttcctggctaaacgctcaccgcagttcacggggaaatagcatgatgataaatgtgcaaactgtggcagtgattgggagcggcaccatgggggcaggcattgctgaagttgctgccagtcatggacaccaggttttactgtatgacatttctgctgaagcgctgacccgcgcaatcgacgggatacacgcgcggctaaattcacgcgtgacgcggggaaaactgactgctgaaacctgtgaacgcacattgaaacgcctgatcccggtgaccgatattcacgcgctggcagctgcggacctggtcattgaagcggcgtctgaacgtctggaagtcaaaaaagcgctctttgcacagctggcggaagtttgcccgccacaaacgctattgaccactaacacttcgtcaatctctataaccgcgattgctgcggagataaaaaatcctgaacgtgttgcggggctgcatttttttaacccggcaccggtgatgaagttggtggaggtggtcagtgggctggcaacggcggcggaagttgttgagcagttgtgtgaactaacgttgagttggggtaagcagcctgtgcgctgtcattcgactcctggatttatcgttaaccgtgttgcgcgtccttattattccgaggcctggcgggcactggaagagcaggttgctgcaccagaagtgattgacgctgcacttcgcgatggcgctggtttcccgatggggccgctggaattaaccgatctgattggtcaggacgtcaattttgctgtcacctgttcggtgtttaacgctttctggcaggagcgtcgttttttaccttcgctggtgcaacaggaactggtgattggtggacggttgggcaagaaaagtgggctgggcgtgtacgactggcgcgcggaacgtgaggcagttgttggcctggaagcggtaagcgacagttttagcccaatgaaagtagaaaagaaaagtgacggtgtcacggaaattgacgatgttttattgattgagacacaaggcgagacggcacaggcgctggcaatacgactggcacgcccggtggtagtgatcgataaaatggcgggcaaggtggtgaccattgctgctgcagcggtgaacccggactcagcgacccgcaaggccatttattacctgcaacagcagggcaaaacagtgctgcaaattgcagattacccaggaatgctgatttggcgaacggtagcaatgatcatcaatgaagcccttgatgcgcttcaaaaaggcgtggcctctgaacaggatatcgataccgccatgcgtcttggggtgaattatccatatggcccacttgcctggggagcgcaacttggctggcagcgaatattaaggctccttgaaaatctacagcatcactatggcgaagaacgctatcgcccatgttcattgctgcgccaacgggcgcttctggagagcggttatgagtcataaggcctggcaaaatgcccatgcaatgtatgagaacgatgcctgcgccaaagcgcttggcatcgacattatctcaatggatgaaggctttgctgtagtgaccatgaccgtcactgcacaaatgcttaacggtcatcaaagttgccacggcgggcagctattttcactggctgatactgcctttgcctacgcctgcaatagccaggggctggcagccgtcgcttctgcctgcacgattgattttttgcgtccaggctttgccggagacaccttaactgctactgcgcaggtacgtcatcagggcaagcaaaccggtgtttacgacatcgaaattgttaaccaacaacaaaaaacggttgcgctgtttcgcggtaaatctcaccgcatcggcggcaccattacaggagaagcctgatgcgtgaagcctttatttgtgacggaattcgtacgccaattggtcgctacggcggggcattatcaagtgttcgggctgatgatctggctgctatccctttgcgggaactgctggtgcgaaacccgcgtctcgatgcggagtgtatcgatgatgtgatcctcggctgtgctaatcaggcgggagaagataaccgtaacgtagcccggatggcgactttactggcggggctgccgcagagtgtttccggcacaaccattaaccgcttgtgtggttccgggctggacgcactggggtttgccgcacgggcgattaaagcgggcgatggcgatttgctgatcgccggtggcgtggagtcaatgtcacgggcaccgtttgttatgggcaaggcagccagtgcattttctcgtcaggctgagatgttcgataccactattggctggcgatttgtgaacccgctcatggctcagcaatttggaactgacagcatgccggaaacggcagagaatgtagctgaactgttaaaaatctcacgagaagatcaagatagttttgcgctacgcagtcagcaacgtacggcaaaagcgcaatcctcaggcattctggctgaggagattgttccggttgtgttgaaaaacaagaaaggtgttgtaacagaaatacaacatgatgagcatctgcgcccggaaacgacgctggaacagttacgtgggttaaaagcaccatttcgtgccaatggggtgattaccgcaggcaatgcttccggggtgaatgacggagccgctgcgttgattattgccagtgaacagatggcagcagcgcaaggactgacaccgcgggcgcgtatcgtagccatggcaaccgccggggtggaaccgcgcctgatggggcttggtccggtgcctgcaactcgccgggtgctggaacgcgcagggctgagtattcacgatatggacgtgattgaactgaacgaagcgttcgcggcccaggcgttgggtgtactacgcgaattggggctgcctgatgatgccccacatgttaaccccaacggaggcgctatcgccttaggccatccgttgggaatgagtggtgcccgcctggcactggctgccagccatgagctgcatcggcgtaacggtcgttacgcattgtgcaccatgtgcatcggtgtcggtcagggcatcgccatgattctggagcgtgtttgagcatatcaacctgcgagtaccctacaatgataaccaatacaaagcttgacccgattgaaaccgcgtctgttgatgagttacaggcgttgcaaacacagcgtctgaaatggacgctcaaacacgcgtatgaaaatgtgccgatgtatcggcgcaaattcgacgcagcaggcgtacatcctgatgatttcagggaactttcagacctgcgtaaatttccctgtaccaccaaacaggatctgcgcgacaactatccctttgacacctttgccgtgccaatggaacaagtggtgcgcattcatgcttcttcgggaaccacaggtaaaccgacagttgtcggctatacgcaaaacgatattgataactgggccaatattgtagcgcgttctttgcgtgcggcagggggctcgcccaaagacaaaattcatgttgcctatggttacggcctgtttactggtgggctgggtgcgcactatggtgccgaacgtctgggcgctacggtgatcccgatgtctggcgggcagacggaaaaacaagcgcaactgatccgtgattttcaaccagatatgatcatggttacgccatcttattgccttaacctgattgaagagctggagcggcagttgggcggtgatgccagcggttgctcgctgcgggttggagtatttggtgctgagccgtggacacaggccatgcgtaaagagattgagcgtcgcctggggatcaccgcactggatatttatggcctgtcagaagtgatggggccgggggtggcgatggagtgtctggaaactaccgacggcccaaccatttgggaagatcatttctatcctgaaattgttaatcctcatgacggcacaccgcttgccgatggtgaacatggcgaactgttattcaccacgctgaccaaagaagcattgccggtcattcgttaccgcacgcgtgatttaacccgactgttaccaggaacggcgcggactatgcgccgcatggatcgcatcagcggacgcagcgatgacatgttgattattcgcggtgtaaatgtctttccgtcacaactggaagaagagattgtcaaattcgaacatttatcgccgcattaccaactggaggtgaaccgccgggggcatcttgattcactttctgtgaaagtggagttgaaagaaagtagcctgacattgacgcatgagcagcgttgccaggtatgccaccagctgcgccatcggattaagtcgatggtggggatctctaccgatgtgatgatcgttaactgtggcagtatcccgcgttcagaaggcaaggcgtgtcgggtgtttgatctgcgcaatattgttggtgcctgacgtatcgtctggccctggtggggtaaagcgccagggccagaagtcgatacgacctgtgctatgattcataaatcacaacaataacaacagactgaagcgaatgagtaaacttgatacttttatccaacatgctgtaaacgctgttccggtcagtggcacatctttgatctcctctctgtatggtgattcgctttcccatcgtggtggtgaaatctggttgggtagtctggctgctttgctggaagggctgggatttggtgagcgtttcgtgcgcaccgctttgtttcgtcttaataaagaaggctggctggatgtttcccgcatcgggcgacgcagtttctatagcctcagtgataaaggcttgcgcctgacgcgacgggcagaaagtaaaatttatcgcgcagagcaacctgcatgggatggtaaatggctcctgttgctctcggaaggtttagataaatcaacgctggctgatgtcaaaaagcagttgatctggcaaggttttggcgcactggcacccagcctgatggcatcgccgtcgcaaaaactggccgatgtacagacacttttgcatgaagcgggtgtggcggataacgtgatttgttttgaagcgcaaataccactggcgctttctcgcgcagcactgcgtgccagagtagaagagtgctggcatttaactgaacaaaatgccatgtacgaaacctttattcagtcattccgcccgctggtgccgcttttaaaagaggcggcagacgagttaaccccggagcgggcatttcatattcagcttttactgatccatttttatcgccgtgtcgtccttaaagacccattgttgccggaggagttgcttccggcacactgggcagggcatacggcgcgtcagctgtgtatcaacatttatcagcgcgtagcgcctgctgctttagcgttcgttagtgaaaaaggtgaaacctcggtcggtgaactgcctgcgccgggaagcctgtattttcaacgttttggcggcttgaatattgaacaggaggcgttatgccaatttatcagatagacggtctgactccggttgtgccagaagagagttttgtccatccgacagcggtattgatcggcgatgttattctcggcaagggcgtttacgttgggccaaatgccagcctgcgtggcgattttggtcgtatcgtggtgaaagatggcgcgaacattcaggataattgcgttatgcacggttttcccgagcaggatactgttgtaggagaagatggacatattggtcatagcgctatccttcacggctgcattatccgccgcaatgcattagtgggaatgaacgcggtagtgatggacggtgcggtgattggcgagaacagcattgttggtgcatccgcatttgtgaaagccaaagcagaaatgccagctaattacctgattgtcggcagcccggcgaaagcgattcgtgaactcagtgagcaggagttggcatggaaaaagcagggtacgcatgagtaccaggtgctggtgacacgctgtaagcagacgttacatcaagtcgagccattgcgggaaattgaacctggcaggaaacgcctggtatttgatgagaatctgcgaccgaaacagtaacagatgtaaaattattttgtccctttaattataaagcagagttatgtttaagctctgctttatttatttgagtattaattcataccgttttttcatcatataattatttataatgagaatgtggttttaatttgtaatttatattatatacacaatttatatatttcatggtctttttttattcacctgaattataattgtgaattataggaaagtatgtttgattagataataatctactggcaatattggatgtcttctatgttttaaataactaattggtcgggttagtgcatccggctttctttatattcgccagaaggatttattatgcaaaggaaaactctattgtcggcctgtattgcattagctctgagtggtcagggttgggcggcagatatcacagaggtagaaaccaccacaggtgaaaagaaaaataccaatgtgacttgtccggcagacccaggaaaactcagtccggaagagcttaaacgcttaccctctgaatgctctcctttagtcgaacaaaacctgatgccatggctttccacaggcgctgctgcgttaatcacggccttagccgtagtggaactaaacgacgatgatgatcatcatcatcgcaacaattctccactcccaccgacaccccctgatgatgaatcagacgacactccagttcccccaactcctggcggagatgagataataccggacgatccggatgatacgcctacacctcccaaaccggtttcgtttaataatgacgttattctcgataaaacagaaaaaacgttaactattcgcgattcagtttttacttataccgagaatgctgacgggactatatctctgcaagatagcaatggtcgtaaggcaacgattaatctttggcagattgatgaagcgaataacactgttgcccttgaaggggtgagcgcagatggcgcaacgaagtggcaatataatcacaacggtgagcttgttattacgggtgataatgccacagtaaacaacaatggcaaaaccaccgttgacggtaaagattccaccggtacggaaatcaacggtaataacgggaaagtgattcaggacggcgatctggatgtcagcggcggcggtcacggtattgatatcaccggtgacagcgcgacggtggataacaagggcaccatgaccgtcaccgatccggagtccatgggtatccagatcgacggtgacaaggccatcgtcaataacgaaggcgagagcaccatcaccaacggtggcaccggcacccagattaatggtgatgacgccacggcaaacaacaacggcaaaaccaccgttgacggcaaggattccaccggtacggaaatcaacggtaataacggaaaagttattcaggacggcgatctggatgtcagcggcggcggtcacggtattgatatcaccggcgacagcgcaacggtggataacaagggcaccatgaccgtcaccgatccggagtccatcggtatccaggttgacggcgaccaggcggttgttaacaacgaaggcgagagcgccatcaccaacggtggcaccggcacgcagattaacggtgatgacgccacggcaaacaacaacggcaaaaccaccgttgacggcaaggattccaccggtacggaaattgctggcaataacgggaaggtgattcaggacggcgatctggatgtcagcggcggcggtcacggtattgatatcaccggcgacagcgcaacggtggataacaagggcaccatgaccgtcaccgatccggagtccatcggtatccagattgacggcgaccaggccatcgtcaataacgaaggcgagagcactatcaccaatggcggcaccggcactcagatcaacggtaacgacgccaccgcgaataacagtggaaaaaccactgttgatggaaaagattccacgggtaccaaaatcgcgggcaatatcggcattgtaaatctggatggtagcctgactgttacaggcggtgcgcatggtgttgagaacattggtgacaacggcacggttaacaacaaaggagatattgttgtttccgatactggatcgattggcgtgctcatcaacggtgagggggcaacagtatccaatacgggtgatgttaacgttagcaatgaagcgacagggttcagcatcacaaccaacagtgggaaggtttcgctggcaggcagtatgcaggttggcgatttctcgaccggggtagatcttaatggcaacaataacagcgtgacgctggcggcaaaagatctaaaagtggtcgggcagaaagcgacgggcataaacgtttctggcgatgcgaatacagtgaatatcactggtaacgttctggttgataaggataaaaccgcagacaatgcggcggaatatttcttcgatccatccgtgggtatcaacgtttacggcagtgataataacgtgacgctggatggaaagttaactgttgtatcagacagtgaggttacttctcgtcagagtaatttatttgatggcagcgcagagaaaacgtcaggtctggttgtgattggcgatggcaataccgttaatatgaatggtggacttgaactgattggagagaaaaacgcgcttgcagatgggtcgcaggttacttccttgcgcacaggatatagttataccagcgttattgtcgttagtggtgagtcgtcggtatatctgaatggagatacgacaatcagcggagaattccctctggggtttgccggggttattcgggtacaggataaagctttgctggaaattggcagtggcgctacgctaacaatgcaggatattgacagttttgaacatcatgggacaagaaccctggatttgcccctatatttccagacatctgttatcacttaacccattacaagcccgctgccgcagatattcccgtggcgagcgataacccagcgcactatgcggatgccattcgttataatgctcgaacgcctctgcaaggttctttgctgccgttaacccgtctggtttgggcatgatactgatgtagtcacgctttatcgttttcacgaagctctctgctattccgttactctccggactccgcaccgccgtgttcttcggttcaagtcccaacatccgggcgaactggcgtgtttcattagcccggtagcatgaaccattatccgtcagccactccactggagacgacggaagatcgttgccgaagcggcgttccaccgctcccagcatgacgtcctgtactgtttcactgttgaagccgccggtagtgaccgcccagtgcagtgcctcacgatcacagcagtccagcgcgaacgtgacacgcagtctctctccgttatcacagcagaactcgaacccgtcagagcaccatcgctgattgctttctttcacggccactctgcctgtatgtgcccgtttcgatggcggtacagcaggttttcgctcaagcaacagcgcattctggcgcatgatccggtaaacacgtttggcattgatcgcaggcataccatcaagttctgcctgtctgcgaagcagcgcccatacccgacgataaccatacgttggcagctctccgataacatggtgtatacggagaagcacatccgtatcatcagtgtgacgactgcggcggccatccatccagtcatcggttcgtctgagaatgacgtgcaactgcgcacgcgacacccggagacaacggctgactaagcttactccccatccccgggcaataagggcgcgtgcgctatccacttttttgcccgtccatattcaacggcttctttgaggagttcattttccatcgttttcttgccgagcaggcgctggagttctttaatctgcttcatggcggcagcaagttcagaggcaggaacaacctgttctccggcggcgacagcagtaagacttccttcctggtattgcttacgccagagaaataactggctggctgctacaccatgttgccgggcaacgagggagaccgtcatccccggttcaaagctctgctgaacaattgcgatcttttcctgtgtggtacgccgtctgcgtttctccggccctaagacatcaatcatctgttctccaatgactagtctaaaaactagtattaagactatcacttatttaagtgatattggttgtctggagattcagggggccagtctaaaccccagaacttacttatgctgattccggtgcgaaaattgttaataaaggtacttgtagattcaattggtcaacgcaacagttatgtgaaaacatggggttgcggaggttttttgaatgagacgaacatttacagcagaggaaaaagcctctgtttttgaactatggaagaacggaacaggcttcagtgaaatagcgaatatcctgggttcaaaacccggaacgatcttcactatgttaagggatactggcggcataaaaccccatgagcgtaagcgggctgtagctcacctgacactgtctgagcgcgaggagatacgagctggtttgtcagccaaaatgagcattcgtgcgatagctactgcgctgaatcgcagtccttcgacgatctcacgtgaagttcagcgtaatcggggcagacgctattacaaagctgttgatgctaataaccgagccaacagaatggcgaaaaggccaaaaccgtgcttactggatcaaaatttaccattgcgaaagcttgttctggaaaagctggagatgaaatggtctccagagcaaatatcaggatggttaaggcgaacaaaaccacgtcaaaaaacgctgcgaatatcacctgagacaatttataaaacgctgtactttcgtagccgtgaagcgctacaccacctgaatatacagcatctgcgacggtcgcatagccttcgccatggcaggcgtcatacccgcaaaggcgaaagaggtacgattaacatagtgaacggaacaccaattcacgaacgttcccgaaatatcgataacagacgctctctagggcattgggagggcgatttagtctcaggtacaaaaaactctcatatagccacacttgtagaccgaaaatcacgttatacgatcatccttagactcaggggcaaagattctgtctcagtaaatcaggctcttaccgacaaattcctgagtttaccgtcagaactcagaaaatcactgacatgggacagaggaatggaactggccagacatctagaatttactgtcagcaccggcgttaaagtttacttctgcgatcctcagagtccttggcagcggggaacaaatgagaacacaaatgggctaattcggcagtactttcctaaaaagacatgtcttgcccaatatactcaacatgaactagatctggttgctgctcagctaaacaacagaccgagaaagacactgaagttcaaaacaccgaaagagataattgaaaggggtgttgcattgacagattgaatctacactgttgaaattcagaatttaggttttgcttttgttactggtgaaaatacaacaggtataaatagtggcacgatctcgttattacaaaatggtaaagatccggcaccgtctcccattgttttactggctactaacggagggagcgccactaatgcaggtacgatcacaggtaaagtgacggaacaacatagcgtatttaacaagtattcaacgggcacatcgaattcatttatttttaataacgatgtcagtagcataacagggttagtcgctcaatcgaatagcacaattatcaatactgacagcggcatcattgatttgtatggtcgtggtagtgtcggcatgcttgctatagcagattcaacagcagaaaatcagggtaaaattacactggattctatgtgggtagatgcaaatgacactaccgcaatgcgagatatagctagcaacagcgccattgacttcggtacaggtgtgggagttggtactgatagttatagtggtgcagggaaaaatgcaacagcaattaaccaattgggcggtgttataactatttataacgccggcgcaggtatggcggcctatggcgccagcaatacagttattaaccaggggacgattaacctcgaaaaaaatggtaattatgacgatagtctggcagcaaatactctggtagggatggctgtttatgagcatggtactgctatcaacgaccagacgggtgttatcaatatcaatgttggtactggtcaggcgttttataacgatggcacaggaacaattgttaactatggtacaatctgcactttcggcgtgtgccaatcggggaatgagtacaataatacagatgatttcacctcactgatctataccggtggcgatacgattacacgaagcggagaaactgtaacgctaaataaatctgctgctgtgactgataagctggctgggaatgttgttaatagcggaacgctttccggtgatcaaattacggtatcaagcggtcttctggaaaataccagcggtggcatcatcaataacttagtaaaacttgacaagggtgccgtcattaaaaatgccggggtgatgacgaataacgtcgatgttagcggtggaatcctcaataatgccggagaaatgactgcgcaaattaccatgaatgctggtgctgatagttcgttagtgaacaacaccggaaccatcaataaaatcgtgcagaacgcgggggtattcaataatagtggcagtgtaacagggcggatgatgtcggctggcggggtctttaataatcaaactgacggggcgattatgagaggtgctgcgctgacaggtactgcagtggcaaataacgaaggaacctggaacctcggaagtagtagtgagggtaacaacaccgggatgctggaagttaataataattcagctttcaataaccgcggcgagtttattcttgataacgacaagaatgctgtgcacatcaaccagtccggtacgctttataataccggtcacatgaacatcagtaattcttcccacaacggagccgttaatatgtggggcggaaatggtcgttttatcaatgacggaacgattgatgtttctgcgaagtcactggtagtcagcgctaataatgccggcgatcagaatgccttcttctggaaccaggataacggggtcatcaacttcgatcacgacagcgccagtgccgtgaaagtcacccacagcaactttattgcccagaatgacggcatcatgaacatcagcggcaccggtgctgtggctatggaaggtgataagaacgcgcagctggttaacaatggcaccatcaacctcggtaccgcaggcactactgacacgggtatgatcggtatgcaactcgatgccaacgccacggcggatgcggtaatcgaaaacaacggcaccatcaatatcttcgccaatgactcgtttgcatttagcgtactgggtacagtaggtcatgtggttaacaacggcacggtggtgattgccgatggggttacgggttctggactgatcaagcagggcgacagcatcaatgttgaaggtatgaacggtaacaacggtaatagcagcgaagtgcattatggcgactatacgttgccggatgtgccgaagcccaatacggttagtgtaacgtcgggaagtgatgaggctggtggcagcatgaacaacctcaacggctatgtcgtcggtaccaacgttaacggcagcgccgggaagctgaaggttaacaatgccagcatgaacggcgtggagattaacacgggctttaccgctggtacggcagacaccactgtgagttttgataacgtagtggaaggtagcaacctgaccgacgctgacgccatcacctcaacgtccgtggtatggactgccaaaggcagcaccgatgccagcggtaacgttgacgtcaccatgagcaaaaatgcctacaccgatgtggcaacagatgcctcggtgaatgacatcgcgaaagcactggatgcgggttacaccaacaacgaactgtttaccagcctgaacgtcggcacgactgctgaactgaacagtgctctgaaacaggtcagcggtagccaggcgaccacggtattccgcgaagcgcgcgtgttaagcaaccgctttagtatgctggcagatgccgcgccgaaagtgggtaacggtctggcgttcaacgttgtcgcgaaaggcgatccgcgtgccgagttaggtaataataccgaatacgacatgctggcattgcgtaaaactatcgacctgagcgaaagccagacgatgagtctggagtacggtatcgctcgtctcgatggtgatggtgcgcagaaagcgggtgataatggcgttacaggcggttatagccagttttttggcctgaaacatcagatgtcgttcgataacggcatgaactggaataacgccttgcgttacgacgttcacaaccttgacagcagccgctcgattgcatttggcaacacgaacaaaacggctgataccgacgtgaaacagcagtacctggagttccgcagcgaaggggcgaagactttcgaaccgagcgaaggactgaaggttacgccatatgcgggtgtaaaactgcgtcacacactggaaggtggctatcaggagcgcaatgccggagactttaacctgaatatgaacagtggcagcgaaacggcggtggacagcatcgtcgggctgaaactggactacgcaggtaaagacggctggagcgctagcgctacgctggaaggcgggccgaacctgagctacgcgaagagccagcgtacggcaagcctggcaggcgcaggcagtcagcactttaacgtcgatgacggtcagaagggcggcggcatcaatagcctgacaagcgtcggcgtgaagtacagcagcaaagaaagttcgctgaatctggatgcgtacaactggaaagaggatggcatcagcgataaaggcgtgatgctgaacttcaagaaaacgttctaatttttagcatgtgatccctaaaccgcaacgctgatacaggttgcggtttttttattgccggatgtggtacgtgacgcgttttgttttgtgtctttcaggacaatagagcaactcatccagtaatcttgtttacaccttcgcattatttatctcttttcgtttctatactgatttttcttaatccgttttattacagggcagggtgcgatgagcagcaatacatttactctcggtacaaaatccgttaaccgtcttggttatggcgcgatgcaactggcaggtcctggagtttttggccccccacgagatcgccacgtcgctataaccgtgctgcgtgaggcgctggcattgggcgtcaatcatattgataccagcgacttttatggtccgcacgtcaccaatcagattatccgcgaagcgctttatccttactctgacgacctgacaattgtcactaaaattggtgcgcggcgtggagaggacgcatcctggttgcccgcattttctccggcagagctgcaaaaagcggtgcacgataatctacgtaatctcgggctggacgtgctggatgtggttaacctgcgcgttatgatgggggatggtcatggcccagcggaaggatcgattgaggccagcctgaccgtgctggcagagatgcaacaacaaggcctggtaaaacatattggcctgagcaacgtcacaccgacgcaggttgcagaggcgcgcaagattgccgaaattgtctgtgtgcaaaacgaatacaacatcgcgcaccgtgctgatgatgcaatgattgatgctttggcccacgatggcattgcctacgtgccgttcttcccgctcgggggctttacaccgctgcaatcgtccacactttccgatgttgctgcgagcctgggtgcaacaccaatgcaggtggcgctggcgtggctgttacagcgttcaccgaatattttgctgatcccagggacgtcttcggttgcgcatttacgggagaatatggctgctgaaaaattgcatctttctgaggaagtgttgtctacgttggatggtatttcgcgagaataacgaatatacaaaagggaaagatgcatttccctttttttcttttttaatggcatggagtgcatatgttgaaggccaggaattgcggctggatacgtttactgcccctgtttatgctgagtctaccagtacaggcggaacttcgatgtgttgcaaatgcagttgatattgaatcatttttttctgcggctaccgctgaagataaacaacaagttgaacaagctatcaacagtagcgtgaatcttgtccccttcggtttatctgcatcgaactggaaagtgcatcgtggcgatttagtggtagaaggtaatatagagagtaatcaaaaattgattgttcttgggaatttgacagtcaaaggtaatatttccactttctctctttctaatccatgggttattctcggtaacgtgacggcaacgaatatagttgcggattcaccactgttaattaccggttcgataaatgcaagtggactggtatttatcgactcatattacgataatccgtctacgattaaggggagtattaatgcgcgtgggatatttatcaatgacataattgcacctgttgttgcgtcttcgacaaatagtgaattcatggtccgtgcgagtgacaaacatgacactgaaaatgtcaaaaaagcgctgatgataataaatcctgatgcatattattgggggctaattaatgatgaagatgctctgaaagaaatttttaagcgaagcaatattcgcatggcagggaatgtctgtaatcagatgaaaaaagaagcgctgtttcgccctaagccttctcctgagttagtgcaagaattgcaaatgctggatgaaggcaaagttgctgcatttgaaggacgagacattgcgacatttgatcttgccgtaatgcgaactctcccaaggcttaaaggaatttcagctaacctacgcaaacaacttattaatagcaatgatgaacaaacgattgaaagtatggcgagatatatgcctgacaatgagattctggagttgaccgatcagcaattgggttaccagcctgttgttctggggttgctcgaccgtgaaccgctctctgtcgaaataatgacgcgaatgagtcgtctacctgatggtgtcggtccgttgaatcttgcgctacgtgaaaatctccctctggatatcgtcatgactctggcgaaaagagattgggatatgatcattcaggagctttataaagatgcgtggttattgcctgaatccattattgatggctatatccgcagtgatgattcctctattcgtcaggtcggtgctggaggacaactcacctacaatcaggcaatgcagttggcgaacgattcatcaaacaatgttgtcacaagcttagcgttcaagctggcagagatgaaacaccatggtcaattgttgcggatgacgccacaagagagtgacaaagttgcaggctatttataccaaaaattcgagaatgacgatgatctaatacgtgtgttatttttagcattgccagataacttacagtttaattttgttaaaaggatggagaaaaaatccccggcctacttttgctgtcgggatatgcaggtaattcactctgacgctgctttacaacggttattgacacgtttcaacgatcctgaagggtggagtaatctggcgaaaaatcagtatctgagcacgtcgatgaaacaaaaaatttggcaacgtgctttatcgcatcggaaaaataatccgaaagcagattcagatgcatatgaaaccagcgctgatatgattttgtctgagctgattagccacggcgaagttgatgaccagatgctattaaatgccaccgccctgatacgttcggacgactgggactttttagagagtgcattaattagttgggataatttacccgctgttgttctcaaggaattacagcaaaacacgccacgcaatgatatttgggcgaagttttttctgaggcaggaaaacagttcccgtgcgcaggttgacgaagcgttacgtgtttattatgcactagaccccgatgcgttagcacaactggatgtactggcaaaacaaccggatcgtatatggtggagtacactggcgaaaagcaatctcacatttttcaagttcggcgcacttaacaaccgccacacaccgcctgcagtactggcggcagaaattgatcccgagtggtggattgtggcgatgaataatccccgttttccagttgatgtattaaaggcgaggctgaaacgtgatcctttgctggcgttagagcttgttaaccctgaactggatttagtccgccagctggcgcttaacggtaagacgcgcgcaatacgggaacaagcgatgagaaaacttgatgagttgtattgatccacaacgtaatgttttttaactatctgattaattggggataatcattcctgacagtgagtccccaataccttgatatattctgaatttttaatgaaacggcgtgttgcgatatctccgtcaggggaattgatgcaccatagcgcaaaccgaattatcaaggattgataatgacgctctaccagataaaaccgctctttcagtcgctgttaaggccgacgatgttttggctttataagcaccacgttacagcgaatcacatcactcttgctgcactggcgctttctcttcttaccggattgctgttgatgttggcggcacaacccatcctctttttgctattgcccatcgtgctttttatccgtatggcgctcaatgcgctggatggcatgttggcgcgtgagtgcaaccagcaaacacgtctgggggcgattttgaatgagactggcgatgttatttccgatattgcgctctatttaccatttttatttttaccggaaagtaacgcatcactcgtgatactcatgttattttgcaccatattgaccgagttttgcggtttactcgcgcagacgattaacggtgttcgcagttatgccggtccatttggcaaaagcgatcgcgcgttaatatttggtctgtggggtctggccgttgccatttatccacagtggatgcagtggaataatcttttatggagcattgcttcaattctgcttctctggactgcgattaatcgttgtcggagtgtgcttcttatgagcgctgaaatataatgctggaaaaatctctggcaacacttttcgcgttgttaattttagcaacgctgataaaccgttttctgctatggcggttaccggagagaaaagggggtgaggttacattacgtattcgtacctggtggggcatcgtcatttgtttttcaatggtgatttcaggtccacgctggatgacgttgacgttttttgcgctgataagttttctggcattgaaagaatattgtacgcttatatctgtacattttccgcgttggttatattggggtattcctcttaactatttgcttatcggttttaattgctttgagctgtttctgttatttatacctttggctgggtttctgatattagccaccgggcaagttttagtgggtgacccctctggttttctgcataccgtgagcgccattttttggggctggataatgaccgttttcgccttgagtcatgccgcctggttattaatgttgccaaccacaaatatccagggcggggcgttactggtgttatttcttttggcattaaccgagtcaaacgatattgcacagtatttatggggaaaatcctgcggcagaagaaaagtggtccctaaagtcagcccgggaaaaacattggaaggtctgatgggcggcgtcatcaccatcatgattgcgtcactgattatcggaccgttactgacaccgctaaatacattacaggcattattagcgggtttgttaattggtattagtggtttttgcggcgatgtcgtgatgtcagccatcaaacgagatattggtgttaaagatagcggaaaactattgccaggacatggcggactccttgacaggattgactcattaattttcaccgctccggtatttttttattttatacgctactgctgttactgaaggaaaatagagaaaatggaaaattcacgcatccctggggaacatttttttaccaccagtgataatacagcgttgttttatcggcactggcccgctttacagcccggggcgaaaaaggtcatcgtcttatttcatcgcgggcatgaacattctggtcgtctacaacatctcgttgatgaactggcgatgccagatactgctttttatgcctgggatgcccgagggcatggaaaaagttcggggccgcgtggttatagcccatctcttgcgcgttcagtgcgggatgtcgatgaatttgtccgttttgctgccagcgacagccaggttggactggaagaggtggtagtgatcgcgcaaagcgtcggcgcagtgctggttgccacatggattcatgattatgcacctgcaattcgcgggctggtgctggcttctccggcctttaaggttaaattgtatgtgccgctggcacgtcctgcgctggcgttatggcatcgtctgcgtggtctgttttttattaattcctatgtgaaaggacgctatttgacccacgatcggcaacggggggcgagtttcaataatgatccgctgatcacacgggcgattgccgttaatatcttgctcgatctctacaaaacgtctgaacgtattattagagatgcggcggcgattacgctccccacgcaacttctgatatcaggcgatgactatgtggtgcatcgccaaccgcagattgatttttatcagagattacgtagccctctgaaagagctgcatctgctgccaggcttttatcacgacacgttgggtgaagagaacagggcgctggcatttgaaaaaatgcaaagctttattagtcgtttatatgctaacaaatcgcaaaaatttgattatcagcatgaagactgcacaggaccatcagcggatcgatggcggctactttctggtggacccgtgccattatcgccggttgatttagcgtatcgctttatgcgaaaggcgatgaaattgttcgggacgcactcttcgggcctgcatctcggaatgagcaccggctttgattcaggcagttcgctggattatgtctatcaaaatcaaccgcaaggtagtaacgcattcgggcgtttagtcgacaaaatctacctgaacagtgttggctggcgcggtattcgccagcgcaaaacccatttacaaatactgattaaacaagccgttgccgatctccacgccaaaggtttagccgtccgcgtggttgacattgccgcagggcatgggcgctatgtactggatgcgctggcaaacgagcctgccgtaagcgatattttgttacgtgattacagcgagttaaatgttgcacaggggcaagagatgattgctcaacggggaatgtctgggcgggtgcgttttgaacagggcgatgcgtttaacccggaggaactcagcgcgttaactccgcggcctacgctggcgattgtctctggcctgtatgagctttttcccgaaaatgagcaggtaaaaaactcactcgcaggtcttgccaatgccatcgaaccgggcggcattctcatctacaccgggcagccgtggcaccctcaactggagatgattgccggggtgttaaccagtcataaagatggtaaaccgtgggtaatgcgcgtgcgttcgcaaggggagatggattcactcgtgcgtgatgccggatttgataaatgcacacaacggattgatgagtggggtatttttacggtttcgatggcggtgcgtcgtgataactgaacgtcggaacgtattgctacaaggcgctggctggttattgttgctggccccgtttttcttcttcacctatggatctcttaatcagttcaccgcggttcaggaccttaacagccatgatatccccagtcaggtattcggttgggaaacggcgatcccttttcttccctggactattgttccttactggagtctggatcttttatatggattttcgctgttcgtttgtagcacgacattcgaacagcgccgacttgtccaccggcttattctggcaacggtaatggcctgctgcggttttttgctctatccgctgaagtttagttttatccgtcctgaagtgagtggggtgacgggatggctattttcgcaacttgaactgtttgatctgccttataaccagtctccttcgctgcatattattctctgctggctactttggcgtcactttcgtcagcatctggctgagaggtggcgtaaagtctgcggcggatggtttttactcatcgccatttcgacgctgacgacctggcagcatcattttattgatgtcatcacagggctggcggtaggtatgttgattgactggatggtgcccgtcgaccgtcgttggaattatcagaaacctgatcaacgtcgaatcaaaatagcactgccctatgtcgtaggcgcgggctcgtgcattgtattgatggagctaatgatgatgattcagttatggtggtcagtctggttatgttggccagtattatcgctactcataattggccgtgggtacggtgggcttggcgcgataacaacagggaaagatagtcaggggaaactaccgcccgccgtttactggctgacattgccctgccgcatcgggatgtggctgtctatgcgttggttttgtcgtcgcctggagccggtgagcaaaatgactgctggtgtttatttaggggcgtttccacgacatattccggcacagaatgcggttctggacgtcacctttgaattccctcgcggacgagccacaaaagatcgactctatttttgtgtaccgatgctggatctggtggttccggaagagggggagctccgacaggccgtggcgatgctggaaacattacgcgaagagcaaggcagcgttctggtccattgtgcattgggattatcgcgcagtgcgctggtggtggcggcatggttgttatgttacggacactgtaaaaccgttaatgaagcgattagctatattcgagccagacgcccgcagattgtgctgacagacgagcacaaagcgatgctgagattatgggaaaacaggtaagtggattgagatgtggactgaatatctacagtccacatcaagaccgtgtccggttatgcagaaacaatgctgtcgatggctgcttttgcgtcagactgtgctttcgctgccatttccggaccgtatgcgatcccttcggcgaagacaaatttcacatcggtaatgccgataaagccgaggaacgtggacagatacggcgtcaccaggtccgttggtccatctttgtggatcccgccgcggctggtaataacgatggcttttttacccgttaccagaccttccggaccgttctcggtatagcggaaagtaacgcctgcgcgggcaaccaggtcaaaatagtttttcaactgagtcgagatgttgaagttatacatcggtgccgcaataacgataacgtcgtgggctttcagctcggcaatcaactcatcggaaagtgccagagcttcctgctgacgcggagtcagcggcgcatcgctcggacgcagagcgccaaccagttcgccatccagtaccggaatcggatttgcagccaggtcgcgaacggtgatttcatcagcggagtgcttttcgcgccattgttcaacaaaataatcggacaactgattagactgagagtaccctgccaggatgctggatttaagaactaataccttgctcatggtgtttccttatagatgtttgaatgggcgatgccccgttgcttgttgacactttattcacaatcctgccacagagatagcgcaataaatcgaagcctatgttcgaatttattgaacaacgcatagaaagccgcgatgtggtactctatatctatcatttaaaagaaaattaatcaggcagactactgcccactaacgttatgacagaacaacaaaaattgacctttacggccttgcagcagcggctggattcgctgatgctgcgtgacagactgcgtttttctcgccgtctgcacggcgtgaagaaggttaaaaatcctgatgcacaacaggccattttccaggagatggcgaaagagattgaccaggcggcagggaaagtcctgctgcgtgaagcggcacgaccggaaattacttatcctgacaatttaccggttagtcagaaaaaacaggacattctcgaagcgattcgtgatcaccaggtggtgatcgtcgccggggaaacgggttctggtaaaacgactcagttaccgaaaatctgtatggagctggggcgcgggattaaaggactgatcggccatacccagccgcgtcgtctggcggcaagaacagtggcgaaccgtattgcggaagagctgaaaacggagccgggcggttgcatcggttacaaagtgcgtttcagcgatcacgtaagtgataacacgatggtcaagctgatgaccgacggtatcctgctggcggagatccagcaagaccgcctgctgatgcagtacgacactatcattattgacgaagcgcacgaacgcagcctgaatatcgattttttgctcggctatttgaaagagttgctgccgcggcgtcctgacctaaaaatcattatcacttccgcgactatcgacccggaacgcttttcgcgccactttaataatgcgccgattattgaagtctccggtcggacctatccggtggaagtgcgctatcgcccgattgttgaagaagccgatgacaccgagcgcgatcagttgcaggcgatttttgacgccgtagacgaactgagtcaggaaagccatggcgacattctgatctttatgagcggcgagcgggaaatccgcgataccgccgatgcgctgaacaagctgaacttacgccataccgaaatcttgccgctttatgcgcggctttcgaacagcgaacaaaatagggtattccagtcgcacagcggacggcgcattgtgctggcgaccaacgtcgcggaaacgtcgctgaccgtaccggggattaaatacgttatcgaccccggtacagcgcgtatcagccgctacagctatcgcaccaaagtgcagcgtttgccgattgagccgatttcccaggcgtctgccaatcagcgtaaaggccgctgtggtcgtgtgtccgaagggatctgtattcgtctctattccgaagacgatttcctctcgcgcccggagtttaccgatccggagattctgcgtaccaacctggcctcggttattttgcagatgaccgcgctggggctgggcgatatcgctgcgttcccgtttgtcgaagcaccggataaacgcaatatccaggatggcgtgcgtctgctcgaagagctgggcgcgatcaccactgatgaacaggccagcgcctataaactgacgccgctcggtcgccagctctcgcagttgcctgtcgacccacgtctggcgcgtatggtgctggaagcgcaaaaacatggctgcgtgcgtgaggcgatgattatcacgtccgcgctctccattcaggatccgcgcgaacgtccgatggacaaacagcaggcatcggacgaaaaacatcgtcgcttccacgacaaagagtctgactttctcgcgtttgtgaatctgtggaattatcttggcgagcagcaaaaggcgctttcttccaacgccttccgtcgcctgtgtcgtaccgattatctcaactatctgcgcgtgcgcgaatggcaggatatctacacccagttgcgtcaggtggtgaaagaacttggcattccggttaacagcgaaccggcggagtatcgcgaaattcacattgcgttgctgaccggtttactttcccatatcggcatgaaagatgccgataaacaagaatataccggcgcacgtaacgcgcgtttctccatcttccccggttctggtttattcaaaaaaccgcctaaatgggtaatggtggcggaactggtagaaaccagccgcctgtgggggcgcattgctgcgcgtatcgacccggaatgggtggagccagttgctcagcatttgattaaacgcacctacagcgaaccgcactgggaacgggcgcagggcgcggtgatggcaacggaaaaagtcactgtttatggtttgccgattgttgccgcgcgcaaggtcaactacagccagatcgatccggcgttatgtcgtgaactctttattcgccacgcgctggtggaaggtgactggcagacgcgtcacgcattcttccgtgaaaacctgaaactacgggcggaagtagaagagctggaacacaaatcacgtcgccgcgatattctggttgatgacgaaacgttgtttgagttctacgaccagcgcatcagccacgatgtaatctccgctcgccacttcgacagctggtggaaaaaagtcagccgcgaaacgcctgatttgctcaactttgaaaaaagcatgttgatcaaagagggcgcagaaaaaatcagcaagctggattacccgaacttctggcatcagggcaatctcaagctgcgtttgagctatcagtttgagcccggcgcggatgctgacggtgtgaccgtacatattccgctgccgttacttaaccaggttgaggaaagcgggtttgaatggcagatccccggtctgcgccgcgaactggtgattgctctgattaaatcgttgccgaaaccggtacgccgtaattttgtacccgcgccaaactatgccgaagcgtttttaggccgcgtcaaaccgctggagttaccgttgctcgacagccttgagcgcgagttacggcggatgaccggcgttaccgttgaccgcgaagactggcactgggatcaggtgcccgatcacctgaaaattaccttccgcgtggtggatgacaaaaacaagaagctaaaagaagggcgctcgctacaagatctgaaagatgcgctgaaaggcaaagtgcaggaaacgctatctgcggtggcggatgacggtatcgagcagagcggcttacatatctggagttttggtcagctgccggaaagctacgaacagaagcgtggcaactacaaagtgaaggcgtggccggcgctggtggatgagcgcgacagtgtggcgatcaaactgtttgataacccgctggagcaaaagcaggcaatgtggaacggtcttcgccgtctactgctgctgaatattccatcgccaatcaaatatttacatgaaaagttaccgaacaaagccaagctgggactgtactttaacccgtatggcaaagtgctggagctgatcgacgactgtatctcctgcggtgtggataaattgatcgacgccaatggtggcccggtctggacggaagaaggctttgctgcgctgcatgaaaaagtgcgtgccgaactgaacgacacggtggtggatattgcgaagcaggtcgagcaaatccttacggcagtgttcaatatcaacaaacgtctgaaagggcgggtggatatgaccatggcgctggggctttctgacattaaagcgcagatgggcgggttggtatatcgcggttttgtcactggtaacggcttcaaacggctgggcgacacgctgcgatatttgcaggcgattgaaaaacggctggaaaaactggcggttgatccacatcgcgaccgtgcgcagatgctgaaagtcgaaaacgtccagcaggcgtggcagcaatggatcaacaaactgccgcccgcacgtcgtgaggatgaagacgtgaaagagatccgttggatgatagaagagttgcgcgttagttacttcgctcaacaacttggtacgccttatccgatttcagataagcgtattttgcaggcgatggagcagattagcggttaaccctgctatttgcctgataaagaaaaaacccggtaagcatttagcgccgggttttttattaattctaaaacggtaagggtaaaaattcaggaattcagaaaaatacaattctctgctgcaagatgaataatgtttatctacagcatttccttaaaagatatgtcaggcttgcggagtggcggttaaggacatacgatttcctcctttcagagtgctccgcttctcactattatctcacgcagtattcttaagggaacgataaggaggaaccatgaacattaccccgtttccgacgctttcgccggcaactatagatgccataaatgttatcggacagtggctggcgcaggatgatttctccggtgaggtgccgtatcaggccgattgcgtgatccttgcaggcaatgcggttatgccgactatcgatgcggcatgtaagattgcccgcgatcagcaaattcctttactgattagtggtggtatcggtcactcgacaacttttttgtatagcgccatcgcacagcatccgcactacaacactatccgcaccactggcagagcagaagcgaccatcctggcggatatcgctcatcagttctggcacattccgcatgaaaaaatctggattgaagaccagtcaacaaactgcggtgaaaacgcacgctttagcatcgcgctattgaatcaggccgtagaacgagttcatacggctatcgttgttcaggaccccaccatgcagcggcgcacgatggcgacgttccgccgtatgactggggacaatcccgatgcaccacgctggttaagttatcccggattcgttcctcagttaggaaataacgcagacagtgtaatctttattaatcagttacaaggattatggccagttgagcgttatctctcactactcactggcgagctgccgcgtttacgcgatgatagcgatggctacggtccccgcgggcgagattttatcgttcacgttgattttccggcagaagtcatccatgcatggcaaacgctgaaacatgatgcggtgctcatcgaggcgatggaaagtcgctcgttacgttaaaaattgcccgtttgtgaaccacttgtttgcaaacgggcatgactcctgacttttatttctgccttttattccttttacacttgtttttatgaagcccttcacagaattgtcctttcacgattccgtctctctgatgattgatgttaattaacaatgtattcaccgaaaacaaacatataaatcacaggagtcgcccatgtcagtacccgttcaacatcctatgtatatcgatggacagtttgttacctggcgtggagacgcatggattgatgtggtaaaccctgctacagaggctgtcatttcccgcatacccgatggtcaggccgaggatgcccgtaaggcaatcgatgcagcagaacgtgcacaaccagaatgggaagcgttgcctgctattgaacgcgccagttggttgcgcaaaatctccgccgggatccgcgaacgcgccagtgaaatcagtgcgctgattgttgaagaagggggcaagatccagcagctggctgaagtcgaagtggcttttactgccgactatatcgattacatggcggagtgggcacggcgttacgagggcgagattattcaaagcgatcgtccaggagaaaatattcttttgtttaaacgtgcgcttggtgtgactaccggcattctgccgtggaacttcccgttcttcctcattgcccgcaaaatggctcccgctcttttgaccggtaataccatcgtcattaaacctagtgaatttacgccaaacaatgcgattgcattcgccaaaatcgtcgatgaaataggccttccgcgcggcgtgtttaaccttgtactggggcgtggtgaaaccgttgggcaagaactggcgggtaacccaaaggtcgcaatggtcagtatgacaggcagcgtctctgcaggtgagaagatcatggcgactgcggcgaaaaacatcaccaaagtgtgtctggaattggggggtaaagcaccagctatcgtaatggacgatgccgatcttgaactggcagtcaaagccatcgttgattcacgcgtcattaatagtgggcaagtgtgtaactgtgcagaacgtgtttatgtacagaaaggcatttatgatcagttcgtcaatcggctgggtgaagcgatgcaggcggttcaatttggtaaccccgctgaacgcaacgacattgcgatggggccgttgattaacgccgcggcgctggaaagggtcgagcaaaaagtggcgcgcgcagtagaagaaggggcgagagtggcgttcggtggcaaagcggtagaggggaaaggatattattatccgccgacattgctgctggatgttcgccaggaaatgtcgattatgcatgaggaaacctttggcccggtgctgccagttgtcgcatttgacacgctggaagatgctatctcaatggctaatgacagtgattacggcctgacctcatcaatctatacccaaaatctgaacgtcgcgatgaaagccattaaagggctgaagtttggtgaaacttacatcaaccgtgaaaacttcgaagctatgcaaggcttccacgccggatggcgtaaatccggtattggcggcgcagatggtaaacatggcttgcatgaatatctgcagacccaggtggtttatttacagtcttaatgagtgaaagaggcggaggttttttcctccgcctgtgcgcgtcagagtttagcgaatttttcgagggtgcgaataagctgtgtgacgaagccatattcgttatcgtaccaggcgaccgttttcaccagttgtaaatcgcccacggcggtaatttccgtttgcgtggcatcaaacaccgaaccgaaatggctgccaatgatatcggaagagactatttcttcatcggtataaccaaatgactcgttattggtggttgcttgtttaagtgcgttattcacctcttcggcagtcacttttttccgagaatcgataccagttcagtgaccgaacctgttttcaccggcacgcgttgcgcatgacctttcagtttgccgctcagttccgggatcaccagaccaatggcttttgccgcccccgtagtgtggggaatgatattttctgccgctgcgcgtgaagcacgtaaatctttaccacgcgggccatccaccagtgactgggtgccagtataggcatgaatggtcgtcatcgtgccgacttctatcccgaaactgtcatgcaaggctttggccatcggcgcaagacagttagtggtgcatgacgccacggaaacaatggtgtcgttgccatccagagtgtcgtcattgacgttataaacgatagttttcatttcaccggcaggggcggaaatcaacaccttcttcgcaccagcatcaagatgcgcctgcgatttctcggcggaggtataaaagccagtacattcgacaatgatttctgcacctttcgctttccacggaatatttttagcctctttttcggcgtaaaccgcgatacttttcccatcaacgataagtgaatcttccgtaaaatcaacgctccaggggaatggtccgtagtttgaatcatgtttcagcaggtaggcgagaatttatggggaagtgagatcattaatagcgacaacgtctatgttgcttttgacttcaagtaatcgacccaacaccagtcgaccgatacgaccaaaaccgttaataccaactttactcatggttttctcctgtcaggaacgttcggatgaaaattgatcctttccaagcttagaccaggatggcgggatgggcaatctccattctcacagtgaaacgtaacgtactgaaaacgggtgaacaatatttaatgaaattttgagaaaagcccgttatgttaacggaaaattatgttaaagcaggaaatgttatggaaaataaatattcaaggttacaaatcagcattcactggctggtctttttactggttatcgcagcgtattgcgcaatggagtttcgtggtttcttcccacgtagcgatcggccactcatcaacatgattcatgtttcctgtggcatctcaattctcgtgctgatggtcgttcgtcttttgttaaggctgaaatacccaaccccgccgattatacctaagccaaaaccgatgatgacgggactggcgcatttgggacatttggtgatttatctcctgtttattgcgctgccagtgattggtttggtgatgatgtataaccggggcaacccgtggtttgcgtttggtttgacgatgccttacgcttcagaggccaatttcgaacgggtagatagcttaaagtcgtggcatgaaacgctggcgaatctgggatattttgtcatcgggttgcacgctgcggctgcactggcacaccactatttctggaaggacaacacacttctacgcatgatgccgcgtaaacgttcctgaaggatatttaaagaaaacgcctgtactaaaaccgacccgtggtacaggcgaagaatacgggtctacatcggaagcgcctattatatttatttgtatgataaataaaaccataatccttgcccatacgtccatctggcttatttttaatcaattcacccgatctttgatctcatcaacggtatcaaaataaaccagcgtataacgttcaaatcgaacataagattcgataaaccatggaggttatatgaaaaaactggcacttattttgtttatgggaacgcttgtttccttttatgccgatgccgggcgcaaaccctgttctggttcgaaaggggggatctcacactgtacggcaggcggcaaatttgtctgtaatgatggttctattagtgcatcgaaaaaaacatgcactaactgaagtgtaaaaggggtgccatgagaaaatgaatctgctagtcaaatgcgcggggaaaatccccgcgcttgcccttacctggacgtgcaggccatgagcgcagcaacctccttatcaccgtcccggaaccgcagttcgtagagcgtttgtcgggtcaggagtgtgaatgtcagaatcgtaatgcagataatgagcagacacaccaccagagggttgtgcttcatagcctttctccttgccggatggcgggtaagaggctaagatctgaattgctaggttcattcgttggcctcggttgatagaaatatcggtcggggccttcgtctttctgattcccggttagcctgaaaacagaaagtctcaggcacccgcaggcatcctatgaggtttccttagggacgaaaataatcacttcacgaaattgcgtgctgttttccagaatttttcgtcattcgggttagccagtttagccattcgttactctcttcattccaatagcattaattttctatgcaataattgttgtaaaaatgtgacgcaaagaggtttttggtcataagtaattaccgtcaagtgccgatgactttctatcaggagtaaacctggacgagagacaacggtaatgaatacaactccctcacagcgattaggttttttgcatcacatcaggttggttccgttatttgcctgcattctaggcggtatcttagttctattcgcattaagttcagccctggctggctatttcctctggcaggccgatcgcgatcagcgtgatgttactgcggagattgagattcggaccgggttagcgaacagttcagattttttgcgttcagcccggatcaatatgattcaggccggggctgcgagtcgtattgcggaaatggaagcaatgaagcgaaatattgcgcaagccgaatcggagattaaacagtcgcagcaaggttatcgtgcttatcagaatcgaccggtgaaaacacctgctgatgaagccctcgacactgaattaaatcaacgctttcaggcttatatcacgggtatgcaacctatgttgaaatatgccaaaaatggcatgtttgaagcgattatcaatcatgaaagtgagcagatccgaccgctggataatgcttataccgatattttgaacaaagccgttaagatacgtagcaccagagccaaccaactggcggaactggcccatcagcgcacccgcctgggtgggatgttcatgattggcgcgtttgtgcttgccctggtcatgacgctgataacatttatggtgctacgtcggatcgtcattcgtccactgcaacatgccgcacaacggattgaaaaaatcgccagtggcgatctgacgatgaatgatgaaccggcgggtcgtaatgaaatcggtcgcttaagtcgtcatttacagcaaatgcagcattcactggggatgacagtagggactgttcgacagggcgcggaagagatttatcgtggcaccagcgaaatttcagctggcaatgcggacctgtcatctcgcaccgaagaacaagcggcggctatcgaacaaactgccgccagcatggagcaactcactgcgacggtgaaacagaatgcggataacgcgcatcatgccagcaaactggcgcaagaggcttctattaaagccagcgatggcgggcagacggtttccggtgtagtaaaaacgatgggcgctatctccacgagttcgaagaaaatttctgagatcaccgccgtcatcaacagtattgctttccagacgaatattctggcactgaatgctgccgttgaagccgcgcgagcgggtgagcaagggcgtggatttgccgttgtcgccagcgaagtacggacactcgcaagtcgcagcgctcaggcggcgaaagagattgaaggcttgatcagtgaatcagtcaggttaattgacctggggtcggatgaggtggcaacggccgggaaaaccatgagcactattgttgatgccgtcgcgagtgtcacacatatcatgcaggaaatcgccgccgcctcggatgaacaaagtagaggcataacgcaggttagccaggcgatttctgaaatggataaggtgacgcaacagaatgcttctctggtagaagaggcctcagcggcggcggtgtcccttgaagaacaggcggcacgattaactgaggcggtggatgtattccgtctgcacaaacattctgtgtcggcagaacctcgcggagcgggtgaaccagttagtttcgctacggtgtgaaaatgttcaaggagggatcgacagatcccttcacctttcagaacggcattgattttcgaatagcgttaatcatcaactggcaaccagaagagaacgtcgcatctacgcgggtcagtattccaatcggttcgcctgcaccatgtcccggaacaggcagggccaccagcgtggcatgacgcaggtcgtcttttacagcgccagaagggacaaaccacacgtaatcgtattcaaccgtaagttgacgagatagcgaagcagacagcgtttcgatacaacccgaaggaattttacagccctggctctgcactaatgcatctgaatgctggcgtggcgcagtgccttctggtgatacaacgaccggccattccagcacccggcttagcgttacgttctcctgaagtagcgggtgattagggcggacaaccagcttcaacgattcaagaaacagcagttcgtaattaagcccggtcatcagttcaggatctgacatccgaccaatgccgatatcgatttccccggtttttaaacccgccagaatcatagggttactcattgtcgcaacttgcaaggtcgtctctttttgttgctgatgaaactgacctataaccgaaggtaatatccccagtgccgcagtaggtagtgcaccaaccctgacgacatcattattaagaccttctttacgatgaagcgaccgtccggcagtgttgatggcgtcaagaactctgactgcatgcgttaaaaattgttcgccgggtaaggtaagttgcgccccctgacgaccacgctcaaacaagcgagcgccagtcagctgctccagttcattcaatgtcttagagagcgcaggttgactcaaattaagggtttcagccgcgcgccccaaagttccttgttgtgcgacagctacgaatgtatgaaggtggcgcaaacggatgcgctgactaaacagactatttttttccataagcgatgttaaaaacgaagcggtgtcgctgacaagtgaagttgtttgattatgataacttgattgcaaaatattattaacaattaaagcaattatgttacagcaaaatggataatattgatgttttcgcggcgagatcacagtttgtaaattcttcccgcaagagtgaatgcggttacctacactccagattactgaccactggaggcagacactatggcgaacagcatcacggcggatgagattcgggaacagttttcgcaggcaatgtcagccatgtaccagcaagaagttccgcaatatggcacgctgctggaactggtagctgatgtgaatctggctgtgctggaaaacaatcctcaactgcacgaaaaaatggtaaatgcagacgagctggcgcgactgaatgttgaacgtcatggggcgattcgcgttgggactgcacaagagcttgctactcttcggcggatgtttgccattatggggatgtacccggtgagctattacgatctctcgcaggcaggggtgccggtacattcgacagcatttcggcccattgatgatgcttctctggcgcgtaatcccttccgcgtttttacctccttactccgccttgagcttatcgagaacgaaattttgcgccagaaagcggcggagattctgcgtcagcgcgatatcttcaccccacgttgtcgacaactgttagaggaatatgagcagcagggcggttttaacgaaacacaggcacaggagtttgtgcaggaagccctggaaacgtttcgctggcaccagtcagcaacggtagatgaagaaacctatcgcgcattgcacaacgaacatcggttgattgctgatgtggtctgttttcctggatgccatatcaaccacctgacgccacgtacgctggatattgaccgggtgcagtcgatgatgcctgaatgcggaattgaacccaaaattctcatcgaggggccgccgcgccgcgaggtaccgattttactacgccagaccagctttaaagcactggaagagacggtgttgtttgcggggcagaaacagggcacgcataccgcgcgctttggtgaaattgagcagcgtggcgtggcattaacgccgaaagggcgacaactgtatgatgatcttctgcgtaacgctggaaccgggcaggataatctcactcaccaaatgcatttacaggaaaccttccgcacttttcctgacagtgagtttttaatgcgtcagcaagggttggcatggttccggtaccgtctgacgccttcgggtgaggcgcatcgtcaggcgattcatcctggagacgatccacagcccttaattgaacgtggttgggtagtggcgcaacccatcacctatgaagatttcttgcccgttagcgcggcggggatcttccagtcaaatctgggtaatgaaacgcagacacgcagtcacggtaatgccagtcgcgaagcatttgagcaggcgttgggttgtccggttttggatgagttccagctttaccaggaagcggaagaacgcagtaaacgtcgctgtggtttgctttaaaatctgaccatccgcctttgcaaaaatttgcctgattttacaaacgaatcaggctcatcccatcgacataaaaaaaatgccgatttatgcatattctctcagttcaacaattggattattaataaatattgtctagagtgagcggtcataaataagcactttcttgccgctgaaaacgaccagcgcgggaccattcacaacaccagaaggactcactttcaggtatggatcgtagacgatttattaaaggttcaatggctatggccgccgtgtgcggtaccagcggcattgcttctcttttttctcaggcggcattcgcggcagattctgatattgccgacgggcaaacccagcgttttgacttctccattctacagtcaatggcgcacgacttagcgcaaacagcgtggcgtggtgcgcctcgtccgttacctgacacgctggcgacaatgacgccgcaggcttataacagtattcaatacgacgccgaaaaatcgctctggcataacgttgagaaccgtcaactggacgctcagttcttccatatgggaatgggattccgtcgccgcgttcgtatgttttctgtagatccagcaacacatctggcgcgtgaaattcactttcgcccggagttgttcaaatacaacgatgcaggtgttgatacaaaacaattagaagggcaaagcgatctcggctttgccggttttcgcgtgtttaaagcccccgaactggcgcgccgtgatgtagtatcatttctcggcgcgagttatttccgcgccgttgatgatacatatcaatacggtttgtcggcccgcggcctggcgatcgacacttacaccgacagtaaagaagagttccccgactttaccgccttctggtttgatacggtaaaaccgggggcaactacctttaccgtttatgcgttgctcgatagcgccagcattactggtgcctataagttcactatccattgtgagaaaagtcaggtgattatggatgtggaaaatcacctgtatgcgcgcaaagacattaaacagctgggcattgcgccgatgaccagtatgttcagctgcggtactaatgaacgtcggatgtgcgatacaattcatccgcaaattcatgactctgatcgtctgtccatgtggcggggcaacggcgagtggatttgccgtccgctgaataatccgcaaaaattgcagttcaatgcttacaccgacaacaacccgaaagggtttggtttattgcaactggatcgtgacttctcccattatcaggacattatgggctggtataacaaacgcccaagtctgtgggtggaaccgcgtaacaagtggggtaagggcaccatcggcctgatggaaatcccaacaacgggcgaaacgctggataacattgtctgcttctggcagccagaaaaagctgtaaaagcaggtgatgagtttgcattccagtatcgtctgtactggagtgcgcaaccgcctgttcattgcccattagcgcgcgttatggcgacgcgtaccggcatgggcggtttctcggaaggttgggcgccaggtgaacactatcccgaaaaatgggcgcgtcgttttgccgtcgatttcgttggtggtgatctgaaagctgccgcgccaaaaggcattgagccggtgattacgctttccagtggggaagcgaagcaaatcgaaattctctatattgaacccatcgatggttatcgtattcagtttgactggtatccgacttcggactccactgatccggtcgatatgcggatgtatctacgttgtcagggggacgctatcagtgaaacatggctgtatcagtatttcccgccagcgccggataaacgtcagtatgttgacgaccgcgtgatgagttaatcgttttttcttcggcaccttcttcgggaggtgccgtctggttaaacacgatcccgctcgcatttttccctaagttaaatgagtaatctgatggtgtgtatttcagatacaccttgtcagccactaacagggagtgcgtatgtttccagaataccgagatttaatatcccgtctgaaaaacgaaaatcctcgctttatgtccttgttcgataaacacaataaacttgatcatgaaattgccagaaaggaaggttccgacggtcgagggtacaatgcggaagtggtccgcatgaaaaaacaaaagctacagttaaaagatgagatgctcaaaatcctgcagcaggagagcgtcaaagaggtgtaaactttcctaagccgccagccaggcggcttttttaacaactgcatggattgactggagataagatgactgaaacgataaaagtaagcgaatcacttgaattacatgctgttgcagaaaatcacgtcaaacctctttatcagttaatctgtaaaaataaaacctggttacagcagtcgctaaactggccgcagtttgttcaaagtgaagaggacacgcgaaaaacggtgcagggtaatgtgatgttgcatcaacgcggctatgccaaaatgttcatgattttcaaagaagatgaacttatcggcgttatctcgtttaatcgtattgaaccactgaataaaaccgctgaaataggctactggctggacgaatctcatcaggggcaggggatcatttctcaggcgctgcaggcattgattcatcattacgcccagtctggtgaacttagacgcttcgtgatcaaatgtcgggtggacaatccgcaaagcaaccaggtcgctttgcgcaatggttttatccttgaaggttgcctgaaacaggctgagttcctgaatgatgcctatgatgatgtgaacttatacgcgcgtattatcgattcacaataaccctgccagcggcgttcgcgtaatgcgctcctcgccgttaatgacttttggaccacggacatgaaccgtgtcgccatcaaaggcttcaacgacggcgtggtcggttaactccacatggttttcaattatcaccgcacctgtaatacggctctcaccttgtatgacaacgtgctcgtcgagcagaatcggtccgccacgtaccacggcatttccgccaaccaagacatgatgttttaacacacaattaccttccacaatggcatattccgccacctgcgaactgtaatgaatcgtcggaatggcatcttcttctatgccagctttcacctgcgcgtgaccgtagactttagcgcaatcgcatagccagacattgttctcttcattaccttcaatactggcaaaatcaaaaacttcggcgcgatgttcaataaaagcataccggacgacggcatcgccataaatttgtgcctggtggacaatacgcgaggcgctaacccttgcgcgatcataaatttggagcaggagttgatggtcgggcgttaagccttgtgcggcgacgatcatagaatgttgatcaattaaggcgtgaccaaatattctacattgcccgtaaactaatgagtcatgaatggtgacgctgtcacttatatatgcaccctggctgatttcactattatcgatccagacgttatccgttgcgtaaacctctccccacagcacgctggtgccggtgatacgcgtattaccggaaatcaccgctccgccgaacgcaatagcattctggtcgtaaatccagcaatttccttcttgtgctaacaccgtttcgcgatcgatccagccgccagcggttcctgctatcacatcgttaaaatcgctaatggcgataatctgccgtaataacacattttttttagtgccatcttcctgataactaaaggctcgctgttcttcacttagacgatatttgcgcatagcgttttcccacaggtgacttactataaccgtagcaaattctgcggctctggctatgctcgagaaaattccataaaatgcatttcaaatatactttataaattaaacaaaatgagtaagaagatgcagagcgataaagtgctcaatttgccggcaggctactttggtattgtgttggggacgatagggatgggatttgcctggcgctatgccagccaggtttggcaggtcagccactggttaggggatgggctggtgattctggcgatgatcatctggggattattgactagcgcatttattgcccgactcatacgctttccgcatagcgtgctggcggaagttcgccatccagtgctgagcagttttgtgagtttgtttccggcaacgacgatgctggtggcgattggttttgttccgtggtttcgcccactggcggtgtgcctgttcagttttggtgtcgtggttcagttggcttatgccgcctggcaaactgcgggattatggcgcggatctcaccctgaagaagctaccacgcctggactgtatctgccgacagttgccaacaactttatcagcgcaatggcctgtggtgcgttgggctacaccgacgccggtctggtgtttttaggcgcaggcgttttctcatggctaagccttgaaccggtgatcttgcagcgtctgcgcagttcgggagaattacccacggcactgcggacatcactcggcattcagctcgctcctgcgctggtggcttgtagtgcctggctgagcgtcaacggcggcgagggtgacacgctggcgaaaatgcttttcggttatggactgctgcaactgctgtttatgctacgtctgatgccatggtatctctcccagccatttaatgcttcattctggagtttctcgttcggcgtatctgcactggcaaccaccggtttgcatctggggagtggcagcgataatggatttttccatacgctggcggtgccgctgtttatctttaccaattttattattgcaatactgctcatccgtacttttgcgcttctgatgcagggaaaattgttagtcagaaccgagcgcgccgttttaatgaaagcagaggacaaagaatgatcattcgtgacgaaaactattttactgataaatatgaattaacccgcacacactctgaagtactggaagcggtgaaagtggttaaaccgggtaaaacgctggatctgggctgtggcaatggtcgtaacagtctttacctggcagccaatggttatgatgttgacgcatgggataaaaatgccatgagtatcgccaacgtcgagcgcattaaatccattgaaaatctggataatttacacacccgagtcgttgatctgaataacctcacatttgatagacagtacgattttattctttcgactgtggtgctgatgttccttgaggctaaaaccatccccgggttgattgccaatatgcaacgttgcactaaacctggtggttacaacctgattgtggcggcgatggataccgctgattatccatgtaccgtcggcttcccgtttgccttcaaagagggagaattacgtcgatattacgaaggctgggagagggtgaaatacaatgaagacgtcggcgagctgcaccgcaccgacgccaacggtaatcgtattaaactgcgtttcgccacgatgctggcacgtaaaaaatgacccggtaagcacaaaacgcgtgaaaattccccacgctgagatgatttactgttcttcttttcggtaagcatattttttatcgaagggatgtgaaattaatcacagtagtcgaagtttttagcagcttaacttactgaaatttaagtactgatgattgacttagcccctttttcggcattgactatgtcgtctgaaaaggggctgaaaaatttattttcaccaacactttttttgccacaacacgaagcggcgctttttgctataacttagaaagtaatataatcatctcaggaaactattcatgcgtaccacatcatttgcgaaagttgcagctttatgcggcttattggctctgtctggttgtgcatctaaaatcacccagccagataaatattctggttttttaaacaattactctgatttaaaagaaacaacctcggctacaggtaaacctgttttacgttgggtagacccgagttttgatcaaagcaaatatgacagcatcgtctggaacccaatcacttattatccggtaccgaaaccgtcgacccaggtagggcagaaagttctggataaaattttgaactataccaacaccgaaatgaaagaagcgatagcgcagcgtaaaccactggttaccaccgctgggccgcgtagtctgattttccgtggggccattaccggtgtagataccagcaaagaagggctgcaattctatgaagtggttcctgttgcattagtggttgcggggacgcaaatggctacaggccaccgtaccatggatactcgcctctattttgaaggtgagctgattgatgcagcgactaataaaccggttatcaaagtcgttcgtcagggcgaaggtaaagacctgaataacgaaagtacgccaatggctttcgaaaatattaaacaagttattgatgacatggcgaccgatgccaccatgtttgacgttaacaaaaagtagttccagacgcgccatcgttagatggcgctttttatccggtgcgccgtaaaaccccatccttcagggcggggatataaggcgcggttttccacctgaccaggtgtttgctgttgttcaatgtattggcggatgacggatattggcgcacctccgcagctactggcaaaatagccaggactccacaaaacgcctttgtagtaatacctgaatgcaatatctggtcgatctcgtcgcagtcacctacccgatacgcctttgaggctgtttaccagactggatatcgccagtttgggaggatagttaattaacaaatggacgtgatctggttcgccatccatttcaaccagttcagcttcaaaatcagcacatacatttgaaaagtaagtgcgtagtttttctgtcgcgtcatggtcaaaaatctggcgtcggtatctggtgacaaagagcaggtgaacatgcatcaggaaaacacaatgccttccacgccggatatcggtttcttttttcacagaccaaagtatcatttgacctgtgaaacgattacaggcatttaaattccagttaagacccggtggtcaacaggagtgtgaaatgaggcgcttcgcaggcgcatgtcgtttcgttttcaatcgtgctctggcacgtcagaatgagaatcatgaggccggtaataaatacatcccttacgggaaaatggcttcctggctggttgagtggaaaaatgccactgaaacgcaatggcttaaagattctccctcacagccattgcaacagtcactgaaagaccttgagcgggcttacaaaaacttcttccggaagcgggctgcttttccccgattcaaaaagcggggacagaatgatgcattccgctacccgcagggcgttaagctcgatcaggaaaacagccgtatttttctgccgaaactgggctggatgcgctaccggaacagccgtcaggtcacgggtgttgtgaaaaatgtcactgtcagccagtcctgcggtaagtggtacatcagtattcagacagaaagtgaagtatcaactccggttcacccttcagcatcaatggtcgggctggatgctggcgtggctaaactcgccacgctgtcagatggcacagtctttgagcctgtaaacagttttcagaaaaaccagaagaagctggcgagacttcagcgacagttaagccgcaaggtcaaattcagcaacaactggcaaaagcagaaacgcaaaatacagcgactgcattcctgtatcgcaaatatccgcagggactaccttcacaaagtcacaacggccgtcagcaaaaaccacgcaatgatagtcattgaggatttgaaggtcagcaacatgtcaaagtcagcagcgggtacggtcagccagccggggcgcaatgtccgggcaaaatcaggtttaaaccgttcgatactggatcagggctggtatgaaatgcgccgccagcttgcgtataagcagctctggcgtggcggtcaggtgcttgctgttccgccagcgtatacaagccagcgttgcgcgtactgtggtcatacagcgaaagagaaccgcctgtcacaaagtaaattcagatgccaggtatgtggatatacagcgaacgccgatgtaaatggcgctcgcaacattttagcggcggggcacgccgttcttgcctgtggagagatggtgcagtcaggccgcccgttgaagcaggaacccaccgaaatgattcaggcgacagcctgaacgtagcagggatccacgtccttcagggcgtggaggatgtcaatatcggtttctgtcagcgattaaattcaacaccacgtaacaaacgcctccggcaattaatccccaaaacgcagaaccaatcccgaccagcgtcaatccacttgccgttaccagaaatgccaccaccgccgcgtctcgctcacgctcattatgcagcgcctgatacaaactgccgccgatggtacttaacagcgccagacctgccagcatctggatccaacttacgggcagggcagccatcatcccggtaatggcactaccaaacagacctgcgagcaaatagaaaatgcctgcaacggcagcggccagccaacgttgatctttatccggatgcgcttccgggctttggcaaatagccgcggtgattgccgcaataccgacggaataaacgccgaaaggggaaaaaaccagtgccagcaatccagtaaatacaattaatggcgaaacaggagccgaatatccagctgctttcattgctgcgatacccggtgcgttttgcgatgccatcgtcaccagaaaaagggggagtgcaacgctcaggctgtgagcaaacgaaaaatcaggggtaatataagtggggagaacgggtttaaagacaacatcagttgtgacaacgtcaccttgcgcgatgacgatcacgatcccaataatcatcgcggcaattaccgcatagcgcggcgcaacggccttggttgccagccataccagcaacatacttccacacaacgtaaattgaccgtccagactggcaaacgcctgtaaaccaaagcgtaataaaatcccggcaagcattgccgccgcaagcgagtgcggaataatgcgcatcagacgagcaaagagtcccgttatgccgcagaggactattagcgcgttggtgacaataaaaacgccgatggcttcgttaagtgttagtccctgcaatccggtgaccaacaaagccgcgccaggcgttgaccatgcggtgagaacaggtacgcgataccataatgtcagagtcagcgtactgacgcccattgccagccccagcgccgtcatccagccagagatttgtgcagtggtggctccggcgacaatcgctgcttgccagattattgccgctgaactggcgtagccaattaataccgccagaaaccccgccagtagcgtgggtggaggaatagaaaacagacgcatagtcacctcgtgcgttatagcgtacaggcaccgtagcatttgtccgttataacgcacaagtgataaacttccgttttgccggaggagtcgcatggaaaatctcgctcgctttttatccaccacacttaaacaactacgccagcagcgcggctggagtctttcgcgactggcagaagcgacgggcgtttctaaagcaatgttagggcagattgagcgtaatgagtccagtccgacggtcgcgacattatggaaaattgccaccgggttgaacgtaccattttcaacatttatttctccgccgcagtccgctacgccttcagtttatgatccacaacagcaggcgatggtgatcacttcgctgtttccttatgatccacaactctgctttgaacacttctcgattcagatggcatctggtgcaataagcgaatcgacgccccatgagaagggggtaatcgaacatgtcgtcgtcattgatggacaacttgatctgtgcgttgatggggaatggcagacccttaattgtggggaaggcgttcgatttgctgcagacgtcacgcatatctatcgtaatggtggggagcaaaccgtacattttcattccctcatccattacccgcgcagttaagcgggaaaactatttcgcaacgtcgcgcttgtggctaaaatagccgccatttttcagctactggataagaatgtgaccgtatcttctcatcgacttgaactgttaagcccggcacgcgatgccgccattgcccgcgaagctattttgcacggtgccgatgctgtttatatcggcggccctggttttggtgcccgtcataatgccagtaatagcttgaaagatattgccgagctggtgccgtttgcccatcgttatggtgcaaaaattttcgtcacgcttaacaccattttgcatgatgatgagctggaacccgcgcaacggctgattactgacctctaccagaccggtgtcgatgcgctgattgttcaggatatggggattctggaacttgatattccgccgattgaactgcacgccagtacgcagtgcgacattcgtacagttgaaaaagcgaagttcctctctgatgttggcttcacgcagattgtgctggcgcgagagctgaatcttgatcagatccgcgcgattcaccaggctacggacgcgaccattgaattctttattcatggggcactgtgcgtggcctattcgggtcagtgctacatttctcatgcgcaaacagggcgtagcgccaaccgtggcgattgctcgcaggcgtgccgtttgccatacacattgaaagacgatcaggggcgggtggtttcctatgaaaaacatctgctgtcgatgaaagataacgatcagactgccaacctcggcgcgctgattgatgctggtgtacgctccttcaagattgaagggcgttacaaagatatgagctacgtgaagaatatcaccgcccattatcgccagatgcttgatgccattattgaagaacgtggcgatctggcgcgcgcttcatcaggtcgtactgaacatttctttgttccatcgacggaaaagactttccaccgtggtagcacagattattttgtgaatgcccgtaaaggcgatattggcgcgttcgattcgccgaaatttatcggcctgccggtaggcgaagtagtgaaagtggcgaaagatcatctcgatgttgccgttaccgagccactggcaaatggcgatggcctgaacgtgttgattaaacgtgaagtcgtcggttttcgtgccaatacggtcgagaaaaccggagaaaatcagtaccgcgtctggcccaatgaaatgccagcagatttgcacaaaattcgtccacatcacccactaaaccgtaatcttgatcataactggcagcaggcactgacaaaaacctccagcgaacgtcgggtggcggtagacattgaactgggcggctggcaggaacaactgattctgaccctcaccagtgaagagggtgtcagcatcacgcatacgctggacgggcagttcgacgaagccaataacgccgaaaaagcaatgaacaatctgaaggatggtctggcaaaactggggcaaaccctctattacgcccgcgatgtgcaaattaatttgccgggggcgctgtttgtaccaaacagtctgttaaaccagttccgccgtgaagctgctgacatgctggatgctgcgcgtcttgccagttaccagcgcggcagccgtaaaccggttgctgatcctgcgccggtttatccgcaaacgcatctgagtttcctcgcgaacgtatacaaccagaaagcgcgtgaattttatcatcgctatggtgtgcagctgattgacgcggcgtatgaagcacatgaagagaagggcgaagtcccggtgatgatcaccaagcattgtctgcgctttgcctttaatctgtgcccgaaacaggcgaaaggcaatatcaaaagctggaaggcgacgccaatgcaactggttaacggcgatgaagtattaacgctaaagtttgattgccgcccatgcgagatgcacgtcattggcaaaatcaaaaatcacatactgaaaatgccgttaccgggaagcgtagtggcatccgtaagtccggatgagctgctgaaaacattgccgaagcgaaaagggtaaaacgccagttttctggttactcacaacttattgaatctgcatgatattgcctgccgggtaaggcgttacgccgcatccggcatcaaatgactcaacgttgtcccgcttctggtttgcgcgatttttgccagtaaaaatgctcgcgcaaaccttccgccgactcttccgccacagcacgcaattcatcgctgtccgcttcatgacgcagctgatgatccacattctttacccacacaaattcatgtcctttgtgccctgccatgagttgtcctgaaaacagagcacacgttaataagacaaccgataacgccttcgtaaacatcctgccacctttttcttaccttttgccgctatgatgccgatcgtttcttgaggttattattcagttttgcaaattagcgcaaagaaattctggaatcttccttcctgattttgcattgcattctgccgttgcggcgatttagtgctattttcgagcaaattacacacggaggtaaacactaatgtttactttgttgatatactcagcggcagggaggcgatgtgaaacaaagcgagttcagacgttggctcgaatctcagggcgtcgatgtagcgaatggcagcaaccatttgaaactcaggtttcatgggaggcgcagtgtcatgccgcgtcacccctgcgatgagattaaagaaccattgcgtaaagcaatcctgaaacaactcggtttgagttaatcgccaattaaaaaggttaatgacatgcgagagacagtcgaaattatgcgttatcccgtcactcttacacccgcgccggaaggcggttatatggtttcttttgtggatatccctgaagcgttgacccagggcgaaactgtcgctgaagcgatggaagcggcaaaagatgctttactgaccgcatttgatttttattttgaagataacgagcttatccctttaccttcgccattaaatagtcacgatcactttattgaagtacctttgagcgtcgcctctaaggtattgctgttaaatgcttttttacagtcagaaatcactcagcaagagttagccaggcgaattggcaaacctaaacaggagattactcgcctatttaacttgcatcatgcgacaaaaatcgacgccgtccagctcgcggcaaaggcgcttggcaaagagttatcgctggtgatggtttaattacagttaacgaaaagttgtcatttttaacaactgatatagactgccgaatcatctgcacataattacgattcgataatgaaaaaataccagcagcttgcagaacaattacgcgagcagattgcgtcgggtatctggcaacccggcgatcgtttgccttcgttgcgtgaccaggtggcgctttcaggcatgagctttatgactgtcagccatgcctatcagttgctcgaaagtcagggatatattatcgcacgaccgcagtcgggttattacgttgcgccacaggcaataaaaatgccgaaagcgccagtcattccagtcactcgagatgaagcagtcgatatcaacacttatatttttgatatgttgcaggccagtcgcgatccgtcggtcgttccgtttgcctcggcctttcccgacccgcgacttttccccctccaacaactaaaccgctcgctggcgcaggtaagcaaaaccgccacagcgatgagcgtgattgaaaacttaccgccaggaaacgcagaactgcgtcaggctattgctcgtcgctatgccttacagggcatcaccatttctcctgatgaaattgtcattactgccggggcgttagaggcattaaacctcagtttgcaagcggtaactgaaccgggcgattgggtgatagtagagaatccttgtttctacggtgcgttgcaggcgctggagcggctacggctgaaggcgttatcggtggcgacggatgttaaagaagggatagatcttcaggcgctggaactggcgttgcaggagtatccggtgaaagcgtgctggctgatgactaatagccagaatccactcggatttaccttaacgccgcaaaaaaaagcacaactggtggcgttgctcaatcagtacaacgtaacgctgattgaagatgacgtttacagcgaactttattttggacgggaaaaaccgctgcctgcgaaagcgtgggatcgccacgatggcgttttgcattgctcttcgttttcgaaatgtctggtgcctggttttcgtattggttgggtcgccgccggaaaacatgcacgtaaaattcaacgcttgcagttgatgagtacgctttccaccagctcaccgatgcaacttgcgctggtggattacctttccacgcgccgatacgacgcccatcttcgtcgcctgcgtcgccagcttgcggaacgtaaacaacgtgcctggcaggcactgctgcgttatctgcctgcggaagtgaaaattcatcataatgacagtggttactttctctggttggagctccccgagccgttagatgccggcgaattaagcctggcggcactgacgcatcatatcagtattgcgccgggtaaaatgttttctaccggtgaaaactggtcacgttttttccgttttaataccgcgtggcagtggggagagcgtgaagaacaggcggtaaaacaattaggcaaacttattcaagaacggctgtaatagcgtttaatttaattcctcttagattgggtaatatgaatttcgaatagcagtcatatttcctaactccttgactatactccagaagataaccttacagacggcataatgcgcggtagctcacaacctgaataaattttctcaggggcgaaggtgtgcctgcaagccgccgtctatggttaaacaaggagatatttttacggcacggcggctgaacaattaattacgacaggagtaagaccttatgagcaagacatttgcccgcagcagcctgtgtgcgctcagcatgacaataatgaccgctcacgccgccgaaccgcctaccaatttagataaaccggaagggcgactggatattatcgcctggccgggatacatcgaacgcggacaaactgataaacaatacgactgggtaacgcagttcgaaaaagagacaggctgcgcggtgaatgtgaaaaccgccgcgacttccgatgaaatggtcagtctgatgaccaaagggggttacgatctggttacggcatccggcgatgcctcgctgcgtttgattatgggtaaacgcgtgcagccgattaataccgcattgattcccaactggaaaacgctcgatccgcgcgtggttaaaggcgactggtttaatgttggcggcaaagtttacggcacaccttaccaatgggggccgaacctgctgatgtacaacactaaaaccttcccgacgccgccggatagctggcaagtggtttttgttgagcaaaatctgccggacggcaagagcaataaaggccgcgttcaggcttatgatggccctatctatattgcggacgctgcgttgttcgttaaagccactcagccgcagttgggcatcagcgatccgtatcaactcaccgaagaacagtaccaggcggtgctgaaagtgctgcgcgctcaacacagtttgatccatcgctactggcatgacactaccgtgcaaatgagcgatttcaaaaacgagggtgtggttgcttccagtgcctggccctatcaggccaacgccctgaaagccgaaggccagcctgttgctaccgttttcccgaaggagggtgttaccggttgggctgataccaccatgctgcatagcgaagcgaaacatccggtttgcgcctacaaatggatgaactggtcattaacgccaaaagtgcagggcgatgtggcggcctggtttggctcgttaccggtagtgccggaagggtgtaaagccagtccgttattaggcgaaaaaggttgtgaaaccaacggttttaactatttcgacaaaatcgccttctggaaaacgcctatagcagaagggggcaagtttgttccctacagtcgctggacgcaggattacattgccattatgggcggtcgctaacttcgctggggtgctttatgacgtacgcagtggagtttgacaacgtctcgcggttgtacggtgacgtgcgcgcagtagatggcgtcagtattgcgataaaagatggtgagttcttctctatgctggggccgtccggctccggcaaaaccacctgcctgcgcctgattgctggcttcgaacagctttccggcggggctatctctatctttggtaaacccgccagcaatctgccaccgtgggagcgggacgtgaatactgtctttcaggactacgcgctatttccgcatatgtcgattcttgacaatgtcgcctatgggctgatggtcaaaggcgtgaataaaaagcagcggcacgcaatggcgcaagaggcgctggagaaagtggcgttggggtttgtacatcaacgtaaaccgtcacaactttctggtggtcagcgccagcgggttgctatcgccagagcattggtgaatgaaccgcgcgtattgctgttggatgaaccgctcggcgcactggatctcaaattgcgtgagcagatgcagctggaactgaaaaaactgcaacagtctctcggtatcacttttatcttcgttacccacgatcagggcgaagcgttatcgatgtccgatcgtgtggcggttttcaataatggacgcattgagcaggtcgattccccgcgcgatctctatatgcgcccgcgcacgccgtttgttgccgggttcgttggtacatcgaatgtttttgatggactgatggcagagaaactttgtggcatgacgggaagcttcgccctgcgaccggaacatatccgcctcaacacccctggtgaactgcaggccaatggcacgatccaggcggtgcaatatcagggcgcggcaactcgttttgaactgaaattgaacggcggtgaaaaactgcttgtgagtcaggccaatatgacaggcgaagaactgcctgccacgctcacgcccggacaacaggtgatggtttcctggtcgcgtgatgtgatggtgccgctggttgaggagaggtgaatggcgatgaatgtattgcaatcaccttcacgtccaggtctgggtaaggtgtccggtttcttctggcataatccggggctggggctgtttttactgctgcttggcccgctaatgtggtttggcattgtctatttcggctcgctgctgacactgttatggcagggattttatacttttgacgatttcaccatgtcggtaacgccggaactgacgctggcgaatatccgtgcgctgtttaatccggcgaattacgacatcattctccgcacgctgactatggctgtggcagtcactatcgccagcgccattctggcttttccaatggcgtggtatatggcgcgctataccagcgggaaaatgaaagcgtttttttatattgcggtaatgttgccgatgtgggcgagctacattgttaaagcctatgcctggacgttattgctggcaaaagatggcgtggctcagtggtttttacaacatcttgggctggaaccactgctgactgcgttccttacattacctgcggtgggcggaaatacgctgtcaacttccgggctggggcgctttctggtgtttctctatatctggttgccgttcatgatcctgcccgttcaggcggcgcttgagcgtttgccgccgtcattgttgcaggcgtcggctgatctcggcgcacgtccacgacaaacctttcgctatgtggtgctgccgctggcaatcccgggtattgccgctggctctatctttaccttctcactcacactgggcgattttatcgtcccgcagctggttggtcctccaggatattttatcggcaatatggtttattcccagcagggggcgattggcaatatgccgatggcggcggcattcaccctggtgccgattattctcatcgcactgtacctggcgttcgtgaaacgtctgggagcgttcgatgcactctgaacgcgcaccgtttttcctcaaactggcggcctggggcggcgttgttttcctacattttcccatcctgataatcgccgcctatgcgtttaacactgaagatgcggcgtttagttttccaccgcagggcctgacgctgcgctggtttagcgtggcagcacagcgtagtgatattcttgatgccgtgacactgtcacttaaagtggcggcgctggcgacattaattgcgctggtgttagggacgctggcagctgccgcgctgtggcgacgagactttttcggcaaaaacgccatttcgctgttactgctgctgcccattgcgctgccgggcattgtcactggtctggcgttattaaccgcctttaaaaccatcaatctggagccgggatttttcaccatcgtggtcggtcatgcgactttttgtgtagttgtggtgtttaacaatgtcatcgcccgttttcgccgcacctcctggagtctggttgaggcgtcaatggatcttggggccaatggctggcaaaccttccgctacgtagtgttgccgaatctcagttcggcgttactggcaggaggaatgctggcgtttgccttgtcgttcgatgaaatcatcgttacgacctttacggcaggtcatgaacgaacgttaccgttgtggttgctcaatcagcttgggcgaccgcgtgatgtaccggtaactaacgtggtggcactgctggttatgttggtaacaaccttgccgatcctgggggcctggtggctaacccgcgaaggcgacaatggtcaataaccactgatacaggaatatgctatgcaacataagttactgattaacggagaactggttagcggcgaaggggaaaaacagcctgtctataatccggcaacgggggacgttttactggaaattgccgaggcatccgcagagcaggtcgatgctgctgtgcgcgcggcagatgcagcatttgccgaatgggggcaaaccacgccgaaagtgcgtgcggaatgtctgctgaaactggctgatgttatcgaagaaaatggtcaggtttttgccgaactggagtcccgtaattgtggcaaaccgctgcatagtgcgttcaatgatgaaatcccggcgattgtcgatgtttttcgctttttcgcgggtgcggcgcgctgtctgaatggtctggcggcaggtgaatatcttgaaggtcatacttcgatgatccgtcgcgatccgttgggggtcgtggcttctatcgcaccgtggaattatccgctgatgatggccgcgtggaaacttgctccggcgctggcggcagggaactgcgtagtgcttaaaccatcagaaattaccccgctgaccgcgttgaagttggcagagctggcgaaagatatcttcccggcaggcgtgattaacatactgtttggcagaggcaaaacggtgggtgatccgctgaccggtcatcccaaagtgcggatggtgtcgctgacgggctctatcgccaccggcgagcacatcatcagccataccgcgtcgtccattaagcgtactcatatggaacttggtggcaaagcgccagtgattgtttttgatgatgcggatattgaagcagtggtcgaaggtgtacgtacatttggctattacaatgctggacaggattgtactgcggcttgtcggatctacgcgcaaaaaggcatttacgatacgctggtggaaaaactgggtgctgcggtggcaacgttaaaatctggtgcgccagatgacgagtctacggagcttggacctttaagctcgctggcgcatctcgaacgcgtcggcaaggcagtagaagaggcgaaagcgacagggcacatcaaagtgatcactggcggtgaaaagcgcaagggtaatggctattactatgcgccgacgctgctggctggcgcattacaggacgatgccatcgtgcaaaaagaggtatttggtccagtagtgagtgttacgcccttcgacaacgaagaacaggtggtgaactgggcgaatgacagccagtacggacttgcatcttcggtatggacgaaagatgtgggcagggcgcatcgcgtcagcgcacggctgcaatatggttgtacctgggtcaatacccatttcatgctggtaagtgaaatgccgcacggtgggcagaaactttctggttacggcaaggatatgtcactttatgggctggaggattacaccgtcgtccgccacgtcatggttaaacattaaggataatattgcagatcgtaagagtatgagatgatcttgcgtactgtcagagcactgatttctctgacagtacgtgctgcgtgcaaaatcactacatcaaataaaccagccaaatctcatagagataagagtaaacaaaccaacagcagcaaagaaatttatcagtactacagttctactggaaacattcatttttgccaccttttatcattgcccctatgtgtatagtacgggttaagaaaatccgcaataatactcattctgaagatggataagggcaagttgctgtttgatgattttttctcaaactggtgaaaaaacttgatgcacgtcaaaaaatgacgcatatttgcgcgcgttttattcatctggctggacgcccgtacatgtctctctatcaacacatgcttgttttttatgcggttatggcagcaatcgcatttcttatcacctggtttctttctcacgataagaaacgcatccgtttcttaagcgcctttctggtgggggcaacatggccgatgagtttcccggtggcgctgttgttttcactgttttaaatcttactcactggcttgacggcaccacgcagacttatatcatttggatgaatcgataaatttcacaagtggctaaggagaaagtatgtcgcatctggatgaagtcatcgcgcgcgtggatgccgcgattgaagagagcgtcattgcccatatgaacgaattattaatcgccctgagcgatgacgcggagttaagtcgggaagatcgctacacccagcagcaacgtctgcgcacagcgatcgcccatcacggtcgcaagcataaagaagatatggaagcgcgccacgaacagttaaccaaaggcggcaccatcctctgattaaaatgagcgtctggctaccaaccaggcgccaaccacaagtaaaattgcgccacaaattgggccgaacaacgcccgtagtggtacgccatgactgcggaagatatccagcatcagaccgccaatcagctgactggcgaccagtacagcaatagttgtcgccgctcccacattctgatatccgctgatactggcgaagacaaaaaacgatcccagcaagccaggtataagtgtccaccagcgcacgctggacaccagttcgccaaaccccgccatgccttgtttaaaccataaaatagaaacaaagagcacaatccccaccagtgagttcagcaacatggcgatgagaatggtagaggaggtctgggtgatgcgcaccatcagcgtgttctggacaaccagaccaattccggcggcaatcaaaaaagcaagggtgagcgactgattcatccaatcgcgtccggttcagtgcgctcgtcgagttgcaactgcataaatgtcagatccagccaacgaccaaatttagtgcctacctgcggcatttgcgcggtgacgacaaatcccagcgactggtggagatgcagcgaggcctgattttgcgattcgatcccggcgaccatgacatgcttcccgcaatcccgcgcttcatcaatcaatcggcttaacaatttacgccccagacctttgccctgatgatcgggatggacataaaccgaatgttccacggtatggcgaaaaccatcgaaactacgccagtcgccaaacgaggcatatcccgtcactacgccgttttcctcgctcaccagcactggataacctgctaaagtccgcgcttcaaaccaggcaatgcggttatcagcatccaccgtttggtcattccagatagccgccgtatacaacacggcgtggttataaatttccgcaatggcagcacagtcggctttgcgggcaaaacggatggacatgtctggcctcaataaaataatgatgatgatgttatcaatactatcgaaaacagcccgaagcaacggattcctcgatgaaattattgcgtgttgcagaggggatgtgacggctgcaaacaaaaccaatcccgtgagcctgctactattgatggattcatgccaaaagcacaggagagcattatggggcaacaaaagcagcgtaatcgacgttgggttctggcctcgcgtccacatggcgcacctgttccggagaatttccgtcttgaagaagatgatgtcgccacaccgggtgaaggacaggtgttactgcgcacagtttatttgtccctggacccgtatatgcgtggacgtatgagcgatgagccatcttattcaccgcctgttgatattggcggcgtgatggtcggcggtacggtgagccgtgtcgtggagtcgaatcatcctgattatcagtctggcgactgggtgctgggctacagtggatggcaagactatgacatatccagtggtgatgatctggtgaaacttggcgatcatccgcaaaatccatcgtggtcgctgggtgtgctagggatgccaggctttaccgcttatatgggcctactggatatcggtcagcctaaagagggcgaaacgttggtggtagctgcggcgacaggaccagtgggggcgacggtggggcaaatcggcaaacttaaaggttgcagagtggtgggggtagccggtggcgcggaaaaatgccgccatgctaccgaggtgttaggcttcgatgtttgtcttgatcaccacgcggatgattttgccgaacaactggcgaaagcgtgcccaaaaggtattgatatctattatgaaaacgtgggcggtaaggtattcgatgcggtgctaccgttacttaatacatctgcgcgcattcccgtctgcggattagtgagcagctataacgctacagagctaccacccggtccggatcgtttacctctgttgatggctacagtgctgaaaaaacgtattcgcttgcaaggttttattatcgctcaggattatggtcaccgcatccatgagtttcagagggagatggggcaatgggtgaaagaggataaaatccactaccgcgaagaaattactgacggtttagagaatgcgccacagacgtttatcggcctgctgaagggtaaaaacttcggcaaagtggtgatccgcgtggcgggtgatgattaaagtttcaacggcggcgtaagccgccataaaaatccaggcaaaaagcttattttcagctttaattaactaaccacatcattgttctgctgctaataacaacaaaggtgagtggtttatgattattcactttaatacaccaggtgaattccttctgccatgcaggcagggttggacagaaaacacgcgaaggaattaaaatgcctggaacgggaaaaatgaaacatgtcagtttgactctgcaggttgagaacgacctgaaacatcagcttagtattggcgcattaaaacctggcgcacgcctgattactaaaaatctggcggagcaattaggtatgagtattacacctgtgcgtgaagcattattacgtctggtttcggtgaatgcgctttctgtcgcacctgcacaagcatttacagttccggaagtggggaaacgtcaattagacgaaatcaatcggatccgctacgaactggaattaatggcagttgctctggctgttgaaaacctcaccccgcaagaccttgcggaactccaggaattgctcgagaaattacagcaggcgcaagaaaagggcgacatggaacaaatcattaatgtaaacaggctatttcgcttagcgatttatcatcgctcaaatatgcccatcctgtgtgagatgattgagcaactgtgggtcaggatggggcctggtttacattatctctatgaagcgattaatccagcggaattacgggagcatatagaaaactatcatctgttactcgctgcgttaaaagcaaaagacaaagagggatgcagacattgtcttgctgaaattatgcaacaaaatattgctattttataccagcaatacaatcgttaaagtaaatgcccggcaaataccgggcatcaaggtaattactcaaatctccacgcaatattcatgccgacaccataatttcgtccgggcgaaggttcgtaatatcgcccgtttgactcattgacaatgacagaaccaacgtattctttatcgaataaattatcgacacgaccaaataaatccacagttaaattgtggtaattgtatttatacccggtgaataagccgacgagagtataagacggcgcttttgccgtattttcatcatctgccataatatcgcccatataacgcgcttccgtgcctgcataccaaccatcttccggtacataacctatcgacgcaaagcccatattacgggcgatccctggcatccgattaccgttacaatcctgttcattgcaaacattgctgcgataggtcgcatcaagccaggtccaggacgcgtttacgcgaaaatctcctgcgaaacgttgatcccatgccagttcagcgccttgacgacgggtctttccggcatttttgtaagtcgtacgcccaccgctactgctatcgacaacaatttcatcatcagtgtcggtctgaaacaatgcgagactaagcagcccatcaccaatacgcgttttactgccgatctcaattgtatcgttggtggatggttttaaacctaagttcataccgctttgcccatcagcacgataagacagctcattaatcgtcggcgtttcaaaacctcgcccggctgccagatagatattccaggcatcggtcattgcatattttaacgaaccggcaggtagccatttatgataactggcatcaccgctgtcatcgccgttacccggagtaacgtaatggtcgttggaatcaaaccacacggagctgtagcgcacgccagcatccagcgacagtttttcgctcagctgccactgcgtctgtaaatagggatcgatgttccacatcagattgcgttcgtcgcgacgcaactcacctttttgcccgtactccggcatgccgctattcaggcggaagttattgtagcccttgcggttttcactcatgttttcgtagttcaggccggtagtgaacgtgaccggaacgcccagttcaccacggtgtgtccagcggctgtctattccctggtaatggcgttgcagggtaatcacgccgcccgcatgtgacgggttaagttgtggtgccatgggtattgactggtactgggtcgtttctcgctctccggcatacatcatcacactcatatcatcccgcgaactcaggctacgctcatagcgcaacccagcctgagtttgcttgatggtttttcgcgtgtcgtactgttctgcacgaggcgcttgttgtggattagccttccattctgctttggttagcccacctgggtcatctgctttgatatccacactattgaaaatcagacttaatttgctggcttcatcaatgcgtacgcccagtttggcattggctaaatttttctgtgcgccactatggtcacgatagccgtgggtcgtaaaacgcgtggttgagacggtgtaatcgacatcgccaggctgtgtgccgtctcccgttgcgcccgttgctttcagcccatagcgccagctgccaaaactgccgtagtaactactggcttcaatggttggtggctgttgtccggtctgggtggtgacattcattaccccaccagacgcgttgccatacagggcagagaaggggccacgcagcacttccacattttgcacactgcttaaatcgatgttggatgtttgcccttgcccgtcgggcatggtggcgggaataccgtccacatacaggcgaataccgcgaataccgtaagtggagcgggagccaaatccgcgaatcgacagctgtaaatcttgcgcatagttctgccggttttgtacctgcaaaccaggcacgccggtcagtgattcggacaagttaatgcgcggtgttgccaggcgcatctcctcgccatccaccacgcttactgctgctggggtatccagttctgaaaccacctgcggtgcggcactgacaatcatagtctgttcatcagcggcaaaaacaacgggggaaaggacaagcagtgcgggcaaaacggtctgtcggacggaaaaaatcttcatgaaaaaagccaggttaagaatgggaaaacgccgtcatggtaatgaaattgtaaatttatggaaaatgaaacggcacaatacgttaagtaattgagaaaattgtagtcgtaacggcaagaaatgctccacatttgagaaaataatgattaccattcccatttataacaagagcgtaacgatgattacgcttagcgaagcattgtgaagcagcaaaaatatcggttcatcaaagggagtcgtcatgcatttacgtcatctgttttcatcgcgcctgcgtggttcattactgttaggttcattgcttgttgtttcatcattcagtacgcaggccgcagaagaaatgctgcgtaaagcggtaggtaaaggtgcctacgaaatggcttatagccagcaagaaaacgcgctgtggctcgccacttcgcaaagccgcaaactggataaaggtggcgtggtttatcgtcttgatccggtcactctggaagtgacgcaggcgatccataacgatctcaagccgtttggtgccaccatcaataacacgactcagacgttgtggtttggtaacaccgtaaacagcgcggtcacggcgatagatgccaaaacgggcgaagtgaaaggccgtctggtgctggatgatcgtaagcgcacggaagaggtgcgcccgctgcaaccgcgtgagctggtagctgacgatgccacgaacaccgtttacatcagtggtattggtaaagagagcgtgatttgggtcgttgatggcgggaatatcaaactgaaaaccgccatccagaacaccggtaaaatgagtaccggtctggcgctggatagcgaaggcaaacgtctttacaccactaacgctgacggcgaattgattaccatcgacaccgccgacaataaaatcctcagccgtaaaaagctgctggatgacggcaaagagcacttctttatcaacattagccttgataccgccaggcagcgtgcatttatcaccgattctaaagccgcagaagtgttagtggtcgatacccgtaatggcaatattctggcgaaggttgcggcaccggaatcactggctgtgctgtttaaccccgcgcgtaatgaagcctacgtaacgcatcgtcaggcaggtaaagtcagtgtgattgacgcgaaaagctataaagtggtgaaaacgttcgatacgccgactcatccaaacagcctggcgctgtctgccgatggcaaaacgctgtatgtcagtgtgaaacaaaaatccactaaacagcaggaagctacccagccagacgatgtgattcgtattgcgctgtaatagatatggcgagggtgaaaacggtgagacttgcctgccttttatcacggcgtatccggcactttcgtcagtaatctgaatttgcccggcacgtagccgggcaattttgcaattaactcgccgtttcaggcttaaacacaatttcctgtttttcttcatcttcctcgacgactggcgcagtgctgtgaatttcagcaacgcgtttgcgcacaccaaaccagcctataaccagcaaaataccgataatcggcagcgccgcgatagtataagtcccgttcgggtaatcgaacgccatcagcacaaggacactcagtaaaaacagtaatgtcagccaggaagtgaagggcgcgccaggcagtttaaaactgacatccgctgctttgccttctttaatcgctttacgcaggcgcatctggcacacgatgataaacgcccatgaagcgatgattcccagcgacgcgaagttcaacacaatctcaaatacgcgcgacggcaccagatagttgaggaatacgccgacgacatacacaactagtgtcgccagaatcccggcatacggcacatgctgacgactcattttcgccataaaactcggtgcggaaccgcccatcgccattgagcgcagaatacgtccggtgcagtacagacctgaattcaggctggagagggcagcggtcagcaccacaatgttcataatgctgccgatatatggcacacccagtttagagaaaaacgtcacgaacggactttgccccgcctgatacgcgctccacggcaataacataaccagcaacaccacggagccgacgtaaaacaggccaatacgccaaatcacactgttaatggctttaggcaccatggtctgcggatctttacattctccggcagctgtacccaccatttcaatggaggcaaaagcaaacactacgccctgaatcaacaccagcgcaggcagcaaaccgtgggggaagaagccgccattatcggtgattaaatgaaagccagtggtgttgccatccagcggctgaccactaccgaggaacactgtacccacgaccaaaaaggtcacaatggcgagcactttaataagcgcaaaccagaactccatctccgcaaaccatttcacaccgatcatattcatggtgccaacgatggtaagtgcagcgagcgcaaagacccactgcggcacgccgccaaacgcaccccagtaatgcatatacagagcgacggcggtaatatcaacaatccccgtcatcgcccagttgatgaagtacatccagccagcaacataagcggctttctcacccaaaaactcacgggcataagaaacaaaactgccactggaagggcggtgtagcaccagctcacccaatgcacgcagaataaaaaacgaaaacaagccacaaattaaataaaccagtgccagtgcgggccccgccatttgcagtcgggctcctgcacctaaaaacaagccggtgccaatcgcgccgccaatggcgatcatctgcacctggcgattgcccatcgctttgtgatacccctcttcgtgggcattaagccagcggcgtttcgcggcgtgttgatctgaagtgtcggtgtcgtgtttactcattgctctccctgattgctttaatgaaaaagtcatataagttgccatgaacaatgtttattcatcctggcgatgatagttatcaccattattctttatgggtataaaactatcggcgcagcatcctacccgttatcgataaacgatgcaaaacatccccttacaatcctgaaggggattaatacaactgacgaaaaaatgacaaatccttttgctggttaacctgtgtactgtcctacacttaatctttaaaagattgtgaggggcatatgattaaggtgtatggcgtacccggatggggctctacaatcagtgagctgatgctaacactggctgatattccttatcagttcgttgatgtcagtggttttgaccacgagggagcttcacgcgagttattgaaaaccctgaacccgttgtgtcaggttccgacactggcattggaaaatgacgagattatgacggagacagcggcgattgcattgatggttctcgatcgtcgcccggaccttgcgccaccggttgggcgcgccgaacgtcagctgtttcaacggctattggtctggctggttgctaatgtctatccaacattcactttcgccgattaccctgagcgttgggctcctgacgcacctgaacagttaaagaagaatgttattgaatatcgaaaatcgctttatatctggttgaattcgcagctcactgctgaaccttatgcgtttggtgagcaactaacgctggtggactgttatctttgcactatgcgcacatgggggcctgggcatgaatggtttcaggataatgccacgaatatcagtgcgattgctgatgctgtatgtcagttaccgaaattacaagaagtattaaaaaggaatgaaattatttgagtgggataccagaagattatgttatttattattcagtaactttatccacaatgatgggcgtaattaattaaattcatggtatgttttttaatttatatcactctccttttcattcagcgtgtctatttcatttcctctgaaaagaaactaactattcacatcgtgcagatgtttcagttgttatcacaggcattctataatctcaaaatgtttttaatgatggatatgctcggagttggagatgcaattaatattaatacaaataaaaatatccggcaggtatgctaaaaggataaatggcgttctctgtatttattcgcaattatctgtaggacaaatatggagagcttgatgagtcagagctaaaacagcaattgattaataaacatgttgatttattcaagaaaatggatgtattttaaatgttgattcttaatataacctaatcaatagattatcaagtgagagctacacattattggaggggcaggggaaaacaccattttgggaacaatgcatcaggtactcttaccactgaagcaagatcatccggcaccaggtggtggtgcagtgctttggaaatggtcccctcgggggagttgtcattattttctatgctatttgcttattatattcatcaggtgaatttaataaattcctaatttgaaatatccactattaagctagtgtttaacgacgttaagatggcaatgtgcagatcatgttatcagggtggggcggtagcgtatattccttatacaaaccatcattcatttcaatgattgttattgaattatttattgttgtgaataaaaagacattatgaatattggtttgactttgcatatcaggttttttattactcgctgtaatgtacgagcctgtcgtgaataacgtcgagaacccatccgttgcgtttgtgattattttgttgactaaacagacacccgtttctctgaagtaaaatcccagactaaatcatcacataaccatgacatttttctgatattccccggtaacgccagatgtcgactcgcttaaccaccctcagccataccagtgaaggccaccgcgtgtcggtccactacggctatgacgataaaggccgcctgaccggcgaacgccagacggtggagaacccggagacgggggaactgctgtggcaccatgagaccggacatgcgtacaacgaacaggggctggcaaaccgcgtcacgccggacagtctgccgccggtggagtggctgacctacggcagcggctatcttgcgggcatgaagctgggcgggacgccgctgctggagttcacgcgcgaccgcctgcaccgtgagacggtgcgcagcttcggcagcatggcaggcagtaatgccgcatataaactgaccagcacatacacccccgcaggccagttacagagccagcacctgaacagcctggtgtatgaccgtgactacgggtggaatgacaacggcgacctggtgcgcatcagcggcccgcgacagacgcgggaatacggctacagcgccacgggcaggctggagagtgtgcgcaccctcgcaccagacctggacatccgcatcccgtatgccacggacccggcgggcaaccggctgccggacccggagctgcacccggacagtacactcacagtgtggccggataaccgcatcgcggaggatgcgcactatgtctaccgccacgatgaatacggcaggctgacggagaagacggaccgcatcccggcgggtgtgatacggacggacgacgagcggacccaccactaccactacgacagccagcaccgcctggtgttctacacgcggatacagcatggcgagccactggtcgagagccgctacctctacgacccgctgggacggcgaatggcaaaacgggtctggcggcgggagcgtgacctgacggggtggatgtcgctgtcgcgtaaaccggaggtgacgtggtatggctgggacggagacaggctgacgacggtgcagactgacaccacacgtatccagacggtatacgagccgggaagcttcacgccgctcatccgggtcgagacagagaacggcgagcgggaaaaagcgcagcggcgcagcctggcagagacgctccagcaggaagggagtgagaacggccacggcgtggtgttcccggctgaactggtgcggctgctggacaggctggaggaagaaatccgggcagaccgcgtgagcagtgaaagccgggcgtggcttgcgcagtgcgggctgacggtggagcaactggccagacaggtggagccggaatacacaccggcgcgaaaagttcatttttaccactgcgaccaccggggcctgccgctggcgctcatcagcgaagacggcaatacggcgtggcgcggggagtatgatgaatggggcaaccagcttaatgaggagaacccgcatcacctgcaccagccgtaccgtctgccagggcagcagcatgatgaggagtcggggctgtactataaccgtcaccggcactacgatccgttgcaggggcggtatatcaccccggacccgattgggttgagaggtggatggaatatgtatcagtatccgttgaatcccatacaagtgatagacccaatggggttagatgcgattgagaatatgacatcaggtggactaatttatgccgtatctggtgtacctggattgattgctgcaaacagcattactaacagtgcttaccagttcggttatgatatggatgctattgttggcggagctcataatggggccgccgatgcaatgagacattgttacttgatgtgtcgaatgactaagacatttggatcaacaatagctgacgtgataggtaaaaatcatgaggcggcaggggatagacaaggtcagccagctaaagaaagaatcatggatcttaaaaataacactgtcggtattgcttgtggcgatttttctgccaaatgtagcgatgcatgtattgaaaaatataacactgggcaactcttcgggttagatggtataaaagcagataatccaataaaagcaaagcaagggagttcagatgcttcaaattattagaggcaaacttgtcatttttttaattaccctttgtttatttgttgtttaccttgggtttgataacaattcaaattctgacatcgtattttatggacataaaacaccaaagagcgttgagatatatctttctgaaaaaaatattatttataaaataattaatgaccaaaaaattagtagagggaatggtcattttataagtataatggttaataattacaggacgcactgtggagtggttgatataaatcttaattttttcaatgatattctttatagcgtgcgattaaaaaacattagtaaactggagaatatggagttctgcgctacaaaacaacgggtgtattttagtgataaaaacaagaaggctagttataaaataattaattatggagactattatgatgttgattattatgataacaatttgaaaaatgaagtttttgactggattggtaaatggtcataatgaacaacaccagaaagagaaaaatataaaatacatacagaaagacatgagagcaagggacggggcagggcaagatcatgaaaattgtgatgtaaatcacgattttcatctttgctttaacgcctacaggtgatcaaaatttaacctttggaataactaaaaagataaaaaaggacgccaggtgagtattcaaagtttgcttgattatatttcagtgacccctgatatacgacaacaaggaaaggttaaacataaattatctgctattttgtttctcaccgtatgtgcagtaattgcaggtgccgatgagtggcaggaaattgaagattttggacatgaaagacttgaatggctaaagaaatatggtgattttgataatggcattccggtcgatgacaccattgcacgcgttgtgagtaacattgacagtttggcctttgaaaagatgtttattgaatggatgcaggagtgccatgaaatcactgatggtgaaattatagcaatagatggaaagaccataagaggctcctttgataagggaaaaagaaaaggagcaatccatatggtgagtgcattctcgaacgaaaatggtgttgtactggggcaggtgaaaacggaagccaaaagtaatgagattacagccattccagagttgcttaacctactgtatttaaagaaaaatttgataaccattgatgctatgggctgtcagaaagatatcgcttcgaagatcaaagataaaaaagcagattatcttctggcagtaaaaggcaatcaggggaaattacatcatgcattcgaggaaaaatttcctgtaaatgtgttttctaattataaaggcgattcgtttagtacgcaggagataagtcatggaagaaaagaaacacgtttgcatattgtcagtaacgtaacgcctgaacttttgtgattttgaattcgaatggaagggattaaaaaagctttgtgtagcattgtcattcaggcagaagaaagaagataaatcagcagaaggtgtaagcatccgatattatatttcatcaaaggatatggatgctaaagaatttgcacatgctatcagagcgcactggctgatcgagcacagtcttcattgggtgttagatgtaaaaatgaatgaagatgccagccggataagaagaggaaacgcagcctaaataatatctggaataaagaagatggcactgaatttattaagagattgcaaagacattaagggtgaagaggaaaagaaagaaggctgcgttaaacacagggaaagatcatcagaagttcactttttgtactaaacaattcgcattttatgtttaaaaattgagatattccttattacctaaagctgttttttattgcttacacatgatcaaatactccttacataattaaggagaacaaaatggaacttaaaaaattgatgggacatatttctattatccccgattacagacaagcctggaaaatggaacataagttatcggatattctactgttgactatttgtgccgttatttctggtgcagaaggctgggaagatatagaggattttggggaaacacatcccgattttttgaagcaatatggtgattttgaaaatggtattcctgttcacgacaccattgccagagttgtatcctgtatcagtcctgcaaaatttcacgagtgctttattaactggatgcgtgactgccattcttcagatgataaagacgtcattgcaattgatggaaaaacgctccggcattcttatgataagagtcgccgcaggggagcgattcatgtcattagtgcgttctcaacaatgcacagtctggtcatcggacagatcaagacggatgagaaatctaatgagattacagctatcccagaacttcttaacatgctggatattaaaggaaaaatcatcacaactgatgcgatgggttgccagaaagatattgcagagaagatacaaaaacagggaggtgattatttattcgcggtaaaaggaaaccaggggcggctaaataaagcctttgaggaaaaatttccgctgaaagaattaaataatccagcgcatgacagttacgcaatgagtgaaaagagtcacggcagagaagaaatccgtcttcatattgtttgcgatgtccctgatgaacttattgatttcacgtttgaatggaaagggctgaagaaattatgcgtggcagtctcctttcggtccataatagcagaacaaaagaaagagctcgaaatgacggtcagatattatatcagttctgctgatttaaccgcagagaagttcgccacagcaatccgaaaccactggcatgtggagaataagctgcactggcgtctggacgtggtaatgaatgaagacgactgcaaaataagaagaggaaatgcagcagaattattttcagggatacggcacattgctattaatattttgacgaatgataaggtattcaaggcagggttaagacgtaagatgcgaaaagcagccatggacagaaactacctggcgtcagtccttacggggagcgggctttcgtaatcttgccctgggcattattgtcgtataaacgctttaccggacacatgacattcacaatgtgtgttaattttactgacatctttcaaaaggagcgtaatcatgccgcacatcgacattaaatgttttccgcgtgaactggacgaacaacaaaaagcagcacttgctgcagatattaccgacgttattattcgtcatctgaacagtaaagacagttcgataagcattgctctacagcagattcaaccagaatcttggcaagctatctgggatgccgaaatcgcgccccaaatggaggctttgataaagaaacctggttatagcatgaatgcttaacccgccgtaacacgcttgccgctggtaacaaacgtcccagcacctaaatgatgcaacgtattgagcttatcatcatcaaactgccagcggccttcgacaaatacccgtgcgtctgccgctgctgatactacttcgccaaacagcgtgtcgtattcttcttgcgcagaagtcgcaggtagcaatcgacactccatccacgccagacatttttcctcgaccagaggcaaaccaaataccgggcctctcacaaccggaatgccatagcaattaaatttatcttcatcacgccccgacacacttcccaccgcccacgtccagttagttgctgcaacgcccgggataacgatgccaaatttaccgttatgttcaatcaactccctggtccatgtcgatttatctaccacaatcgccacgcgtggaggttcaaactccaccggcattgaccaggctgcagccataatgttacgccgctgggattgctcatcgaaactggtgatcaagaccgttgggccatgatttaacagacggctggcatggtgtaattctatggggatgaatcggctcatggtatcgcctcgcgaagaaggtttttttaagcgtagtccgtaacgcaataagtaacgaaattaacgggattggcgatttgcgaacgtgatgcatgtccgcgatcgcacaaaatagccggtgcggcgtctattccaggttataagttgagaaaaccactaagggaaacgcctgatgacgcccattctgaatcactattttgcccgtattaactggtcgggagctgctgcggtcaatattgatacgcttcgtgcattgcacctgaaacacaattgcaccattccgtttgaaaacctcgacgttttgctgccgagggaaatacagcttgataatcaatcgccggaagagaaactggtgatagcccgtcgtggcggttactgttttgagcagaatggcgtgtttgagcgggtgttacgcgagctggggtttaacgttcgcagcttgttagggcgcgtagtgttatcaaatccgccagcattaccgccgcgcacccatcgtttgctgttggtggaactggaagaggaaaaatggattgctgatgtcggtttcggtgggcagacgctaaccgcgccgattcgtttagtttccgatctcgtgcagaccacgccacacggagagtatcggttgttgcaggagggtgatgattgggtgttgcagtttaatcatcatcagcattggcagtcgatgtaccgttttgatctctgcgagcagcaacaaagcgattatgtgatgggcaatttctggtcggcgcactggccgcagtcgcattttcgccatcatttgctgatgtgccgccatttgccggacggcggcaagctgacactgaccaattttcattttacccattatgaaaatgggcacgcggtggagcagcgaaatctaccggatgtggcgtcattatatgctgtgatgcaagaacagtttggtctgggcgtggatgatgcgaaacatggctttaccgtggatgagttagcgctggtgatggcggcgtttgatacgcacccggaggcgggaaaataatttatgtcaggttgccggatgcggcgtaaacgccttatccggcatacattagcccggttgtagacctgacaggcgaagcgcatcagacaacggtttcagagttcaattgcccattcggcatgaaacaaaatcaccgctgtgcctgaaatggtgactttttccggttggttatcacgaattgtcaccgtcacttcaatcataccgtcacgccccaatgcgcgcccctgatggcctttaacacgcaacacgttgccatcgtggggcaatacgttgtgatgtaccaaccatgcacccatcgggccattggcattgccagtcaccggatcttccacaataccaatcgcaggcgagaacatgcgaccatcggtttcgtttttgcctgggcggatctggaacgggaagaaaccattgcagccaatctttttgctgatagcggtcagcgcattaaggtcaggcgaaagggcgtcgatatccacttccggtttcagtgggatcatcacttttgagtgtcctgttgttgccacctgaattggcaagcctggcagaatatcgtcctcagtgagatgaagcgcgttgataatcgccgcacgtgtttcaccttccagcggtggctcaaagcccggcgtaccttgttccagcgaaatacgataatcatcgttgtgcttttcgatagtcacgcgatgttttcctgccagcgatgtttgccagatcgtgcaatttcctaaacctaacaccttcgcacgtacatagtgcgcagctactgtcgcgtgaccgcaaatcggcacttcaaccgttggcgtaaagtagcggatgcgcacatcgctgtcgtcgctgtgcagcagaaaagcagtttccgaatggcctaactcgcgggcgataagctgcatttgcgcttcgctaagattatcggcggggaaaacaacaccggcagaattgccgcgaaacggttgtgaggtaaaagcatcgacgtggtacacctgcggtttcattaacgttctcctgtgactggagaactatcatagcctgcaagtggccggagagcgaagggctatccggccagggtgaaattatcgccgcgaacgcacaatttgatatcgacgagtaaagtactcaaacggcgcgctccacacatgcaccagtcgggtgaacgggaagagcaggaagatggtcattcccaacaccagatgcaggcggaagacgaacgctacgccgttgagcatctctgacgatccaccacggaaagtgacaatgctttgcgcccaacccaccagcttcatcatttcgctaccatcaggatactgtgctgaaaacggtatggtacttagccccaacagacactggatcagcaaaatgctcatgatgatgatatccggcgtagtggaagtggcacgcacgcgctgatttgtcagcctgcgccacagcagtcctgcgccgccaatcaacgtcaacacaccgcaaataccgccgagcaccatcgccatgagttgtttcgctgccactggcaaaaaccacgcgtacatccagtgcggcgttaacatgccgaacaagtgcccgaagaaaatccccaaaatgccgatatggaacagattcgaccatatcaccatcccgcgtttatcgagcatttgacttgaggaggcgcgccaggtgtactgcccgtagtcgtagcgcagccagctgccgaggaaaaacaccgtcgcacaaatgtacgggtagatatcgtaaaaaaagacgttcagatactgaatcatttcccacctcccgcactgatgtcgacatattgcggcgcgacatcctggctaaagcgtcgctgatattgattaagcggcgagctgtcacacgccgtggcgttatcttcaataaacttcacctgttcctcttcccacactgcatcaagcgcctggcgggtgtcatcgcgctcttcgctgtttacttgttttgtgacactgtcacttgaaagggagcttcccgccagttgcagcagagcatcaaacaacgcgtaccacggtgcctcgcgttgttttaagcgaccgccaagcagggcgaggatcggcgcaacattgagcaatccttctttcgcctgatcgtcaggcagtacgcttaaatactccagatacagcggtagataatcgggcagttcccgacaatccagctgcaggccgaccttttcatactccgccagcaggtccaccattgcctggccgcgatcgcgggactcggcatgaacatgttcgaacagcagcagcgacgtggtgcgcccgcggtcaaacacttcgcaccattcggcctgtttatccagcagcggcgcgttaagcaggttgtgggtgaaatccgtaagcatcggcgcgtcgcggcggatcaacgccagcgcgtcctccttgcattcccacaacagctcgtccggatactccatcaacaggccgatcactttgaggatctgcattattcgccctccgctttgtcgcgcacttcggtgatgttgatggcatcgatacggctactgttgaacaggttgaatttactgtccgaaccgtggcaaccgtcgccaaaggtaaaaccgcagccgttgcgttctgcgaaggcatcgcccgccatttcccgatggctggtcgggataacaaaacgatcttcatagttggcaatggcgagatagcgatacatctcttcgacctgggcgacgctcaggcctacttcgtcgatggcacgagtatcagtaacgccttccacggtttgtgaacgcatatagtggcgcatcgccatcatccgtttcagcgcccgcagtaccggaccggtatcgccggcactcaacatattggcgagatattgcaccggaatacgcaggctttcgatggcgggcagcacgccttcgcttttcggcaaaccgcccgcatctgcgtaggactgaatcggtgacagcggaggaacgtaccagaccatcggcagggtgcggtattcagggtgcaacggtagtgccagtttccagtccatcgccattttgtagactggcgaacgctgggcagcgtcaatcacattttgtggaataccttgtttcagggcttcctcgatcactgagggatcgtgtggatcgaggaacacttcgcactggcgttcatagaggtcaacttcgcgctcggtgctcgccgcttcctcgatgcggtcggcgtcgtaaagcagcacgcccagataccggatgcgacccacgcaggtttctgagcacacggtcggttgaccggactcaattcgtgggtaacagaagatgcatttttctgacttgccgcttttccagttgaagtagatttttttgtacggacaaccgcttatgcacaaacgccagccacggcatttatcctgatcaatcagcacaatgccgtcttcttcgcgtttgtagatagcgccgcttgggcaggtcgccacgcagctgggattgaggcagtgttcgcacaggcgcggcaggtacatcatgaaggtgttttcaaactgcccgtacatctccttttgcatggcctcgaagttgcggtcgcgggcacgtttttcgaactcaccgcccagcagttcttcccagtttggcccccagatcactttgtccatccgtttgccgtcaatcagtgaacgcgggcgagcagtaggaatatgtttgccttccggtgcgctatgcaaatgttcgtagtcgaaggtgaaaggttcgtagtaatcatcaatctgcggcaccaccgggttggcgaagattttggttattacgcccatcttgttgcccagacgcgggcgtatcttgccattcacatcacgcacccagccgccttgccactcttcctgatcttcccagtttttcggataaccaatgcccggtttggtttcgacgttgttaaaccatgcgtactccatgccttcgcgcccggtccagacgtttttacaggtcaccgaacaggtatggcagccgatacatttgtcgaggttaagcaccatgccgacttgtgaacggattttcattttttcgcctcctgtacctgatcgcgaccttcatcatccagccagttaacgttcttcatcttgcggatcatgatgaactcatcgcggttcgatccgacggtgccgtagtagttaaagccccaggccagctgcgcgtaaccgccaatcatatgcgttggtttcgggcaaacgcgggtaaccgagttatgaatgccgccgcgcatgccagttacttccgaaccaggaatattcataatgcgttcctgggcgtgatacatcatggtcatgcccggcggtacacgttggctgaccaccgcgcgggcagtcagcgcgccgttggcgttgaatacttccacccagtcgttatcgacaatggtcagttctcgggcatctgtttcgctgatccagacaatcggtccaccgcgagagagcgtcagcattagcaggttttcactgtaggttgagtgaatgccccatttctggtgcggcgtcaggaagttaagtgctttttccgggaagccgtttggcggtatctggcgcatctcactgacgctacgggtgtcgataggcgggcgataagccaccaggctttcaccaaaagcacgcatccacggatgatcctgatagagctgctggcgtcccgacagcgtgcgccacggaattaactcatgaacgttggtgtatcccgcgttataggagacgtgatcgctttccagaccggaccaggtggggctggagataattttacgcggctgcgcctgaatatcgcgaaagcgaatcttctcgtcctctttgtgcagcgccagatgggtatgttcgcgcccggtgatctcgcccagcgcctgccacgctttgactgcaacatgaccgttggtttccggtgccagtgccagaatcacttctgaagcgtcaatggcggtgtcaatcagcggacgcccctgtgccgggccatcacgcttggtgtaattgagtttgccgaggaaatcgatttcatcctgggtattccacgaaatccctttaccgccattgccaagtttgtccatcaatggcccgagcgaggtaaagcgttcatacgtagcagggtagtcgcgctccaccgccacaatattcggcgcggttttgcctggaatcagatcgcattcgcctttgcgccagtcgagcacttcacacggctgtgagagctctgccggagagtcatgcagtaggggttgtaataccacgtcggtttctttgccaagatgacccacgcacacttgcgaaaatgctttggcgatacctttgtagatttcccagtcgctgcgtgattcccacgccggatcgaccgccgcagaaagcggatgaataaacggatgcatatccgaggtgttcatatcgtctttttcgtaccaggtggcggtgggcagaacgatatcggagaacaggcaggtactggacatgcggaagtcgagcgtcaccagcaggtcgagcttgccttcaatcgctgcagtttgccactcgacttcttccggtttgatcccgtcgctggcaccgagttcctcgccctgaatcccgctttcggtccccagcagatacttctgcatatactcgtggcctttgccggaggagccaagcaggttagagcgccagacaaacaaattacgcggatgattgctgctgctatctggttgttcgcaggccatacgtaaatcgcccgatttcagcgcctgggcggtaaattctgtgggggataatccggccttgtcggcttcagctttaatcccgagcgggttacgccccagctgcggcgcagaaggtagccagcccatacgttcggcgcgaacgttgaaatcaatcagatgaccgctgtacttactggcatcggcgagcggtgaaagtaactcctgagcagagactttttcatagcgccattggctggaatgattgtagaaaaacgaggtgctgttcatttggcgcggtggtcggttccagtcgagcgcaaaggccagtggcaaccagccggtttgtgggcgcagtttttcctggccgacatagtgtgcccagccgccaccgctttgcccgacacaaccgcagaagatcagcatattgatcatcccgcggtagttcatgtccatgtgataccagtggttaacacctgcgccgaggataatcatcgagcgcccatgcgttttatgggcggtatcggcaaattcacgggcgatggtttcaatatactggcgcggcacgccggtaatttgctcaccccaggctggggtgtacggtttgatttcagcgtaatctttcgcactgttttcatcttccagcccgcgatcgaggccgtaattcgccagtaccaaatcataaacgctgaccaccggacaggtgttgccatcgactaacgtcaggtttttaacgggcaattggcgcaccagcaccggattgtgttttacgctgcgaaaatgcggattttcaatgccgccaaagtaggggaaggccacgcctgcaacagcgtcatgttgaccgagcagggttaacgacaattcggtttccgtaccggcggcaatggattccagattccatttgcctttttctccccagcggaaaccaatcgaaccgttcggcactaccaattcacctgcggtattaactgctacggttttccactgcggattgttgctttcgcccagtccatccaccaggtcagatgcgcggatcatgcgcccgggaacgtagctaccatcgtcgcgaggctccagcattaccagcatcggcatgtcgctgtagcggcggcagtagttgataaagtagtcgctgggattatcgagatgaaactcttttaaaatcacatggcccattgccatcgccagggcgctatcagtgccttgtttcggtgccagccactggtcgcacaatttggccacttcagagtagtcaggggtaatggcgatggttttagtgcctttgtagcgtacttcggtaaagaagtgggcgtccggcgtacgtgtctgcggtacgttagacccccaggcgatgatgtagctggagttataccagtcggcagattccggtacgtcggtttgctcgccccaggtcatcggcgaggcgggcggcaggtcgcaataccagtcgtagaaacttaaacaggtgccgccaagcagcgacagataacgcgttccggcggcgtaagaaaccatcgacatcgccgggatcggcgagaaaccggcaacgcgatccgggccgtaggttttgatggtccagacgttagcggcggcaatcagctggtttagttcctgccagttggagcggataaacccgccgcgcccacgcacttgtttgtagctcaggcacttttgcggatcgttcataatcgatgcccacgccagtaccggatcgctgtgttgcttgagggcttcgcgccacagttcaatcagtcgtttacgaatgagcgggtatttcaggcggttagcgctgtaaagataccaggagtaacttgcgccacgcgggcagccgcgaggttcatgattgggcaggtcagggcgagtgcgcgggtagtcggtctgttggatttcccaggtcaccagaccatttttaacgtagattttccagctacaggagcctgtacagttaacaccgtgggtggaacgcacgattttgtcgaactgccaacgctggcgatagctgtcctcccagtcgcggttgctatgcatcacctgtccgtgaccatcggcaaaggtttcgcccttttgtttgaagtagcgaaagcgatccaaaagtttactcatgacatgactcctgctccaggaatgaattgggatctgatgccttgtcggatgcgacacggttgtacatcaggcatcgatctcttatttttggctgaacttccgccgaccataaaccagccaggtcagcagcacacaaacgatgtagaagattaaaaacactttcatcgcgccgaccggagagccggtcatattgagcgacatgccaaacgcctgcggaataaaaaagccgcccactgcgccaatggctgagataaagcccagagccgccgccgtttcggtgacggcttctttatgagcttgctcatcactaccgcctttcatctttacccgataaatggttatctggcgaaagatgacggcgatcatctggaaagtagaaccacttcccagacccgcagtcagaaacagccccataaatacggcgtaaaaggcgatgaaattaccggagcctgtgcccggtaaggtaaggaacagcagggcactgaaaatcgccataaaaataaagttgatcaacgtcacccgcacgccgccgaacttatcggaaatagcaccaccaaccgaccgcgcgatggcaccgataaatgggccaaagaacgccaggcgcagaatattcacatccgggaactgggtttttgccagcatggcaaaacccgcagaaaaaccgataaacgaaccgaaggtggcaaggtaaagcaggctcagcagccagagatgcaggcgttgtaagacagggagctggtcggcaattgaggcgcgtgaactggcgatatcattcatccctgaccatgcggcgatcgtggcaatcgccagtagcggtacccaaatccatgcggcattcgccagcgacatcaccgaaccgtcggcctgcggtacgccattgacgccgagaaaggcaaatacaggtacaaaaatgaccagcggtgcaaccagctgcattacacttacacctaagtttcctaatccgccattaatcccaagagcgctcccttgtttggcttttggaaagaagaaactgatattgcccatgctcgaagcaaagtttgcacctgcaaaaccgcatagcaaagcgataacgataaatatcccaaaaggagtattcggattttgcacggcaattccgagccagacgcaaggaataatcaggattgcagtactaaaaaccgtccatcggcgtccaccgaatataggcaccataaaggagtagggaacacgcaataatgcgccagaaacggagggtaatgcggttaataaaaagagttgatcggtagtaaaattaaaaccgattttattgagattaacggtaactgcgctaaatagcatccagacacagaaggcaagaagtagacaactgactgatatccagagatttcttcgagcaatatgttttcctttattttcccagaaggccggattttctggtttccagtcgcgcaaaagataacgactatttttctcattttgcagtgccatattgttcctcacatgcacacattggtaatgaaaaaaagacaaaacacgaggtaaggcgcaatagccagttattagaattaaggatgaattgggtgaagtgctgattgaaagaatagataagaaagcgtaaccgcgggggcagaatggggattaagtagccagatatgtgttactaaatgtaactaacaagctaaccttcaaacggggttaatctttgaacgtatgtcatgtttcaacccttcagatcgtgaatctaaagggttacatattaactatattatcaacaagaccagacacttatagaattagtgatgatttattcactaaaaaggccatgaactggaggaaaacgatctgtccagaaggtctatcggttcctctcttattgcctgattgtaataatcgttattacagtaagtattgtttatttcatctaaggtcatgtttttaacttttatattcatctggtttacaacttcctctgtcttgtaagtgtgtatattatatggggtatatgcttttttaataggatagtgaaacaattcgttatccacatctattccgtcagagtgaacttcaaatgcaccaggcgaaagaattgccaggccagtattaagcttaagtgctggggaaaacaaattaaataacatgagctgcatagtagggcaattgttcttcccagaaacatttaaaaaatttaagttttgctctgttttattatggggaataaagttccaatatcggatgtattattagtatcaatgtgggttattttattattgtccagtcttaaacttttgatagatggaagataagtcaggaaatcaagatttatatatttcaactggttgttagcagcgtttaatgtctgaacattgcagaagttgctatagaatattttaatttcagaaagcaaattgttgttaataagtaacgtattcaagttgggaaataagtcattgtgtaaacttgttagtttattatgggatagatccagcagtaagagttcatttttattacctgcaacaatatcagttaattgattatggctgagattcaggtattgcagccattcgcaagattctaattgcacaaactctagttgattatgtgccgcactaaaataagtaactgatgaaagcctatctatatcaatatttctgagagcattattattcatagatatatgtgtaatacttacatttctgccttgaggaaaatttattgactcaagagcattactattcagacttagctttacgagtctatcgtagttggttgcatcaaaatgtgtgaattggttattatcaagattgatagatgtgaagttttgcagccctggtggttgagtggttaaattaagtcctgataaatcaatggtcacttcattagtgtcatcaattatatttcttactgcagtccagtactgcatttgtgcaagtggatcattgttgatgccgttaactaatacatgccaaagatgttttgatgatattagttgatcaatgtcattggttggcagtaaattgttattgcttaagtttaaatattccagttttgtagtgtttttggcgtttaaatgtgcaatatggttgtcgtttaaagtgattgttttcatcctgggatgattgtgtaatataaggtcagtgatcatattgtgatgggcacttaactcaatcagagattcttgccgcgcgagccgttggcttcatcgttatagcctttaaaatcatattcccagtgaccaaaaccaatcatttgatcattgatttgcgtttctcctttaaagccgagacgggcataagttttatcaccatcgtcacgcttatcatcagtaaaataacgtagagcggtaaccttgccataaaggtcgagtttattaccatccttgttatagacttcggcagcgtgtgctacgttcgcagctaacaaaccagttacaaccaccgcaactatttttaatttcatttaacagaatccttttaattatcgttaaacgtattttctaaacgaattttaaacggcgtcatttataaatgacatactgtttttaaaatagaatggtgattaaaaacaatgagaaaaatagatgaaataatattatttatcgatatgtgatcgaagtcgaaatgagatataaggtgaattactggtatttgaaatttatttttttaatattgtcggaatttatctgattaactaccgggccgtagacccggcagttattttaaccacgacgtgtcgccagccagcagagcagggaaccgccgcagaccatcagcgcgccttgccagaacgagaacgacagcggggcgctgagcagcacggctgcaagcgctgaggaaagtacaggcgtaaaatacgaacctaccgccataatggtgacattgccatgcaatataccgacattccatgcagcataagcaaatcctaaggtaaatgccgcagagatgagtttaatcatgacgggcgtgctaaatatcatttctggttgtggcgtaagaaaatagtaaacccacagacttgctcccgttagcaggacaaaaacggtaattccattaaatccgcgtgcgtatttattcgttactgtgcaataggctgcccagataaacgcaccaatgaacgccaggaaataactcaatgggctggtggtgatattattgatgatttcatcataatgtaacccattgtcaccgcctaacacccaacagacgccgacgagggctaataataatccaggtacaatcaaccagttggttttctgaccattaaacagaatggcaaagagaattgtcaggctgggccacagatagttcaccatacccacttcaatcgcctgatgatgggtcgccgcataccctaaggaaagcgccagacagatttcatagctgacgaataacagactcccggcgagtaaatagcctttcgggatttgccgaatacgcggaaatccaaccgtgaagattaacagcagcccgcttaatgaatagatagcagctgcgccgccgaccgggccgagcccctcactgacaccgcgaatcaatcctaccatcgtgctccacaggacgatcgctatcagccctatgagcgttgctttttgtcgtgtcatgctcgctgttttgtctctcttgccgttaaaaattaagctgaattttatagcatttttttaactggcctgtcaggcagtggtgcgtttttctaccgctattgaggtaggtcaatttgcgaaggcggattattttgtggcaaacagatgttctttttgatttcgcgcaaaaagattcagaattttactgttagtttcctcgcgcagtaatacccctgaaaaaagaggaaagcaatggacgtcagtcgcagacaattttttaaaatctgcgcgggcggtatggctggaacaacagtagcggcattgggctttgccccgaagcaagcactggctcaggcgcgaaactacaaattattacgcgctaaagagatccgtaacacctgcacatactgttccgtaggttgcgggctattgatgtatagcctgggtgatggcgcaaaaaacgccagagaagcgatttatcacattgaaggtgacccggatcatccggtaagccgtggtgcgctgtgcccgaaaggggccggtttgctggattacgtcaacagtgaaaaccgtctgcgctacccggaatatcgtgcgccaggttctgacaaatggcagcgcattagctgggaagaagcattctcccgtattgcgaagctgatgaaagctgaccgtgacgctaactttattgaaaagaacgagcagggcgtaacggtaaaccgttggctttctaccggtatgctgtgtgcctccggtgccagcaacgaaaccgggatgctgacccagaaatttgcccgctccctcgggatgctggcggtagacaaccaggcgcgcgtctgacacggaccaacggtagcaagtcttgctccaacatttggtcgcggtgcgatgaccaaccactgggtggatatcaaaaacgctaacgtcgtgatggtgatgggcggtaacgctgctgaagcgcatcccgtcggtttccgctgggcgatggaagcgaaaaacaacaacgacgcaaccttgatcgttgtcgatccccgttttacgcgtaccgcttctgtggcggatatttacgcgcctattcgttccggtacggacattacgttcctgtctggcgttttgcgctacctgatcgaaaacaacaaaatcaacgccgaatacgttaagcattacaccaacgccagcctgctggtgcgtgatgattttgctttcgaagacggtctgttcagcggctacgacgctgaaaaacgtcaatacgataaatcgtcctggaactatcagctcgatgaaaacggctatgcgaaacgcgatgaaacactgactcatccgcgctgtgtgtggaacctgctgaaagagcacgtttcccgctacacgccggacgtcgttgaaaaca

(The sequence listing continues in the following parts.)

The invention claimed is:

1. A non-naturally occurring *Escherichia coli* bacterium lacking all genomic and non-genomic IS1, IS2, IS3, IS4, IS5, IS10, IS30, IS150, IS186, IS600 and IS911 insertion sequences, wherein the genome of said bacterium is between 4.41 Mb and 2.78 Mb.

2. The bacterium of claim 1, wherein its genome is between 4.27 Mb and 2.78 Mb.

3. The bacterium of claim 1, wherein its genome is between 4.00 Mb and 2.78 Mb.

4. The bacterium of claim 1, wherein its genome is between 3.71 Mb and 2.78 Mb.

5. The bacterium of claim 1, wherein the parent strain of said bacterium is selected from the group consisting of DH10B, DH5α, INVα, Top10, Top10F, JM103, JM105, JM109, MC1061, MC4100, XL1-Blue, EC100, and EC300.

6. The bacterium of claim 1, wherein the bacterium is competent to be transformed.

7. The bacterium of claim 1, wherein the bacterium lacks Insertion Sequence mini-circles.

8. The bacterium of claim 1, wherein the bacterium comprises a vector.

9. The bacterium of claim 8, wherein the vector lacks insertion sequences.

10. The bacterium of claim 9, wherein the vector comprises a nucleic acid encoding a polypeptide, and wherein the nucleic acid is operatively linked to an expression control sequence.

11. The bacterium of claim 9, wherein the vector is a plasmid.

12. A method of propagating a nucleic acid comprising:

(a) transforming a bacterium according to claim 1 with a nucleic acid to create a transformed bacterium; and (b) propagating the transformed bacterium of step (a) under conditions that allow replication of said nucleic acid.

13. The method of claim 12, wherein the bacterium is transformed by electroporation.

14. A method of producing a polypeptide comprising:

(a) incubating a bacterium according to claim 10 under suitable nutrient conditions to allow expression of the polypeptide; and (b) optionally isolating and purifying said polypeptide.

* * * * *

UNITED STATES PATENT AND TRADEMARK OFFICE
CERTIFICATE OF CORRECTION

PATENT NO. : 8,119,365 B2
APPLICATION NO. : 11/400711
DATED : February 21, 2012
INVENTOR(S) : Frederick R. Blattner et al.

It is certified that error appears in the above-identified patent and that said Letters Patent is hereby corrected as shown below:

In the Specification

Column 1, line 17, insert --This invention was made with government support under GM035682 awarded by the National Institutes of Health. The government has certain rights in the invention.--.

Signed and Sealed this
Twenty-fifth Day of November, 2014

Michelle K. Lee
*Deputy Director of the United States Patent and Trademark Office*